United States Patent 9,675,668 (MODIFIED POLYNUCLEOTIDES ENCODING HEPATITIS A VIRUS CELLULAR RECEPTOR 2) - sequence listing, part 26

SEQ ID NO: 55657 - DNA, 396 bp, Artificial Sequence
  Description of Artificial Sequence: Synthetic coding sequence
atgagcactgagcggacctcttggacctctctctctacaatccagaagattgcactcggacttggaatccctgcaagtgccactgtcgcctacatcttgtatcgccgttaccgcgagagtagggaagagaggttgacatttgttggggaagatgatatcgagattgaaatgagagtgccccaagaggctgtcaagctgatcatcggtcgccagggggctaatatcaaacagcttcggaaacagactggagccagaattgacgtggataccgaggatgtgggagatgagagagtgctcctgatctcgggctttcctgttcaggtatgtaaggctaaggccgctattcaccaaatccttacggagaatacaccggtcagcgagcagctgtccgtgtag

SEQ ID NO: 55658 - DNA, 1254 bp, Artificial Sequence
  Description of Artificial Sequence: Synthetic coding sequence
atggctctaaaagtccttcttgagcaggaaaagaccttttttaccttattagtcctgttgggatacttaagttgtaaagtgacctgcgaaagcggagattgcagacagcaagaattcagggaccggtcaggaaattgtgtgccgtgtaatcagtgcggccctggcatggagctttccaaggaatgcgggtttggttatggagaagatgcccagtgtgtcacttgtcgtctgcaccgctttaaggaggactggggttttcagaagtgtaagccctgtctcgactgcgccgtagtcaatcgcttccaaaaagccaactgctccgcaactagtgacgccatatgtggagactgtttgcccggattctacagaaaaaccaagctggtgggcttccaggatatggaatgtgtgccctgtggggacccaccacccccatacgagcctcattgtgcctcaaaggtgaatctggtaaaaatagcatcaacagcctccagccccagagatactgccctggccgcagtcatctgtagcgcgcttgccacagtgctcctggccctgctaatcttatgcgtcatatactgtaaacggcaatttatggagaagaaaccatcctggtctctgagatcccaggatatccagtataatgggtccgagttaagctgcttcgaccgacctcagctgcacgaatacgcccacagagcgtgttgtcagtgccggcgtgatagcgtccaaacgtgcggtcccgtgagactgctccccagtatgtgctgcgaggaagcatgttcgcccaaccccgcaacactgggctgcggcgtccatagcgccgctagcctccaggctcggaacgcgggtccagccggagagatggtgccaactttttttggaagcctgacacagtcaatatgtggcgagttctcagatgcctggccactcatgcagaacccgatgggtggcgacaacataagtttttgcgatagctaccccgagctgacaggggaggatattcattctctgaatccagagcttgagagtagcacgtcgctggactccaatagctcacaggacttggtgggcggagccgtgccagtgcagtcgcattctgagaacttcaccgctgctaccgatctgtcccgctataataacacgctggtcgagtcagcctcaacgcaggatgcccttaccatgagaagccagctcgaccaggaatccggcgcagttatccatccagccacccagacttcgctccaggaagcctag

SEQ ID NO: 55659 - DNA, 1272 bp, Artificial Sequence
  Description of Artificial Sequence: Synthetic coding sequence
atggccctaaaagtgctgttggaacaagagaaaacgtttttcacacttctggtgttgctcgggtatcttagctgtaaagtcacttgcgagagtggagactgcagacagcaggaatttcgcgataggagtggcaactgcgttccctgcaaccaatgtggccctggaatggagttgtcaaaagaatgtggatttggctatggagaggacgctcagtgcgtgacatgtagactgcacaggtttaaagaggactggggatttcagaagtgtaagccatgcttggattgcgctgttgtcaacaggtttcaaaaggcaaactgttctgccacatcagacgccatttgcggcgattgcttaccgggattctaccggaagacaaagctcgtagggtttcaggatatggagtgtgtgccatgcggcgaccctcccccaccatatgagccacactgtgcctctaaggttaatctggtgaaaattgcatccaccgccagcagcccacgcgacacagcattagctgcagtgatttgcagtgccttggctacagtgctacttgctctgctgattttatgtgtgatttactgtaaacggcagttcatggagaagaagccaagctggtctctgaggagtcaggatattcagtataatgggagcgagttaagctgtttcgataggcctcagctccatgaatacgctcatagggcctgctgccagtgtaggcgcgactctgtgcagacctgtggccctgtgcggctcctgccctccatgtgctgcgaagaggcctgcagccccaaccctgccacactcggatgcggcgtccattcagccgcatcactgcaggcaagaaatgccggtccagccggagaaatggtgcctacattctttggctccctaacccagagcatctgtggtgaattctcagatgcttggcccctcatgcagaatcccatgggtggggacaacataagtttctgcgactcatatccagaattaaccggcgaggacatccattctctaaatcctgaactggagagctctacgagtctggatagcaactcttctcaggatctagtgggaggagctgttcccgtacagtcccactccgagaactttaccgctgctactgatctctcaaggtataataacacattggtggagtctgctagtacccaagacgccctgacgatgaggagtcagcttgatcaggagagtggagccgtgattcaccccgcaacccagacttccctgcaggtccggcaacgtctcgggtcactgtag

SEQ ID NO: 55660 - DNA, 1254 bp, Artificial Sequence
  Description of Artificial Sequence: Synthetic coding sequence
atggctctgaaagtgttgctggagcaggagaagacttttttcacacttctggtcttactgggctacctgagctgcaaggtaacttgcgagtccggggactgcaggcagcaggaattccgtgaccgttctggaaattgtgttccatgcaatcaatgcgggcctggaatggagcttagcaaggaatgcgggttcggttacggcgaagatgcccagtgcgtgacatgccgattacaccgtttcaaagaggactggggattccagaaatgcaaaccatgtcttgactgtgccgtggtgaacaggttccagaaggcaaattgttccgccacaagcgacgctatctgcggtgactgcctgcctgggttttatcgtaagaccaagctagtgggcttccaggacatggaatgtgttccttgcggggatccgcctcccccatacgagccacactgcgcaagtaaagtgaacctggtaaagatcgcctctaccgcttcttcgccccgtgatacagcattggctgccgttatctgctctgcccttgcaaccgtcctgctggccctgctgatcctgtgcgtaatctattgcaagcgccagttcatggagaagaaacccagttggtccctccgctcacaggatattcagtacaacggatctgagctgtcatgctttgacaggccgcagctgcatgaatatgctcaccgagcatgctgccagtgccgcagagacagcgtccagacatgtggtccagttcgcctgttgcccagcatgtgctgcgaagaggcgtgtagtcctaacccagctacactagggtgtggcgtccactcagcagcgagcctgcaagccaggaatgctggaccagctggagaaatggtgcccacatttttcggtagtctaacccagagtatctgtggcgagttctcagacgcatggcctctgatgcagaaccctatgggcggagataatatttcgttctgcgatagttacccggagctgaccggtgaggatatccactccctgaaccccgagttggagagttcgaccagccttgacagtaattctagccaggacttggtgggcggagccgtgcccgtacagagccacagcgaaaattttactgccgctaccgatctctctagatacaataacacactcgtggaatccgccagcacgcaggatgccttgaccatgagatcacagttggaccaagagtcaggcgcagttatacaccctgccacccagacatccctgcaggaggcatag

SEQ ID NO: 55661 - DNA, 858 bp, Artificial Sequence
  Description of Artificial Sequence: Synthetic coding sequence
atggagtgtgtgccatgcggggatccccctccaccttacgaaccgcattgcgcctccaaagtaaatttggttaaaatcgcgagtactgccagttctcccagagacacagctttggccgctgtgatatgctccgccctggccacagttctgcttgcacttctgatcctttgcgtgatttactgcaaaaggcagtttatggaaaaaaagcccagctggtcacttcgctcccaggatatccagtacaatggatctgagctgagctgcttcgaccgtccccagctgcatgaatatgcacaccgggcatgctgccaatgtaggagagatagcgttcagacttgtgggcctgtccgtctcctccccagcatgtgttgtgaagaggcgtgttctcctaatccggcaacactaggctgcggtgtccacagcgctgcctcacttcaggcccgaaacgctggtccagcaggtgaaatggtgccaaccttcttcggttcacttactcagagcatatgcggcgaattcagtgatgcttggcctctgatgcagaatcctatgggaggggacaacattagcttctgcgacagttacccagaactgactggagaagatatccattctctgaatccagagttagaatctagcactagcttagattctaactcttctcaggacctcgtggggggtgcagttccagtgcagtctcattcagagaattttacagctgccacagacctgtctcggtacaacaataccctcgtcgagtccgctagtactcaggatgcactcacgatgcgttcacagttagaccaggaatccggcgctgttattcatcctgctacgcagacctctttacaggaggcatag

SEQ ID NO: 55662 - DNA, 570 bp, Artificial Sequence
  Description of Artificial Sequence: Synthetic coding sequence
atggcagccaagcagcctccccctcttatgaaaaaacactcgcagactgacctggtcagcaggctgaaaacacgaaagatcctcggtgtaggcggtgaggatgatgacggcgaggtccaccggtccaagatctcccaagttctcggaaacgagatcaaattcacgatccgcgagccattagggcttcgtgtctggcaatttgtgtccgccgtgctgtttagtggcatcgctattatggcactggcctttcccgaccagctatatgacgccgtgtttgacggggctcaggtaacttcgaagactcctataagactttatggcggagcgttactgtctatttcattaattatgtggaatgcgctgtacaccgccgagaaggtgattatcagatggacgcttctaacagaagcctgttacttcggagtacagttccttgttgtcaccgctacactggctgagacgggcctgatgagccttggcattttattgctcctggtgtccaggctgctcttcgtggtcataagtatttactactattatcaggtcggaaggaggccgaaaaaagcttag

SEQ ID NO: 55663 - DNA, 411 bp, Artificial Sequence
  Description of Artificial Sequence: Synthetic coding sequence
atgaccaccggtagatgtatcgcgcctagagtgtggcagtttgtgtctgccgtactcttcagcgggattgccattatggctctggccttccctgaccaactgtacgatgcagtgtttgacggcgctcaggtcacaagcaagacaccgatccgcttgtacgggggagcattgctcagcatctctcttattatgtggaacgccctgtatacagccgagaaagtcattatcagatggaccctcctgaccgaggcttgctactttggagtccaatttctggttgtcaccgccaccctcgccgagaccggattgatgagtctcggcatcctgctgcttttggtcagtcggcttctttttgttgtgatcagtatttactactattaccaggtaggaaggcgccctaaaaaggcatag

SEQ ID NO: 55664 - DNA, 570 bp, Artificial Sequence
  Description of Artificial Sequence: Synthetic coding sequence
atggcagccaaacagcctccacctctgatgaaaaaacattctcagaccgacctagtgtccagactgaagactaggaagatcctcggggtggggggagaggatgacgatggtgaggtccataggagcaaaatcagccaagtgcttggtaacgaaatcaaattcactattcgggagccccttggtctcagagtttggcagttcgtaagcgccgttctcttttctggtattgctatcatggcactggccttcccggaccagttgtacgacgctgtgtttgacggcgcacaggttacctcaaagacaccaatcaggctatatggtggcgcactcctgagtatttccctcattatgtggaatgccttatatactgctgagaaggtgatcatccgttggactcttctgacagaggcctgctactttggggtgcagtttctcgtcgtaaccgccacgctggcagaaacaggactgatgtcgcttgggatcttgctcctcttggtctccagactactgtttgtggtgatttcaatatattattactaccaggttggcagacgccctaaaaaggcgtag

SEQ ID NO: 55665 - DNA, 570 bp, Artificial Sequence
  Description of Artificial Sequence: Synthetic coding sequence
atggctgcaaaacagccccctcctttgatgaaaaagcatagccagactgacctggtgtccagactgaagacccgtaagattctgggcgtcggaggagaggacgatgatggggaagtacatcgatcaaagatctcgcaggtacttggcaacgagatcaagttcaccatccgggagccccttggtctccgcgtttggcaattcgtgtcggccgtactgttttctgggatagccataatggccctggccttccctgaccagctatatgatgccgtcttcgacggcgctcaggtcaccagtaagacccctataaggctgtacgggggagccctgttatccataagcctgattatgtggaacgccctctatactgcagaaaaggttataattcgctggacgctgctcaccgaggcctgctatttcggggtacaatttctcgtggttacagcaaccctagccgagaccggtcttatgtctcttggcatccttcttctgctggtcagccgcttactgttcgtagttatttcgatctactactactatcaggttggtcggaggccgaaaaaggcttag

SEQ ID NO: 55666 - DNA, 297 bp, Artificial Sequence
  Description of Artificial Sequence: Synthetic coding sequence
atggccgcaaaacagcctcccccactgatgaagaaacattcacagaccgatctcgtgtctaggcttaaaaccagaaagattctcggtgtcggtggcgaagatgatgatggtgaggtccatcgaagcaagatctcccaggtgcttggaaatgagatcaaattcaccatacgggagcccctcggcctcagagtttggcagtttgtaagcgccgtgctgtttagtggcatcgccataatggctctggcctttcccgatcagttgtacgacgccgtgtttgatggtgcccaggtgacctag

SEQ ID NO: 55667 - DNA, 222 bp, Artificial Sequence
  Description of Artificial Sequence: Synthetic coding sequence
atggccgcaaaacagccacctcctttgatgaagaaacactctcagacagaccttgtctctcgtttgaaaactcggaagattctgggagtgggcggagaagatgacgacggcgaggtgcacagatcaaaaatcagtcaggttctaggcaatgagattaagttcaccattcgggagccccttggtctgagagtctggcagtttgtgtctgccgtgttgttttag

SEQ ID NO: 55668 - DNA, 477 bp, Artificial Sequence
  Description of Artificial Sequence: Synthetic coding sequence
atggccgctaagcagccgcctcccctgatgaagaagcatagccagactgacctcgtgtcacgcctgaaaacccgaaagatcctaggtgttggcggagaagacgacgacggcgaggttcaccgctctaaaatcagtcaggtattggggaatgagattaagtttactattcgcgaacctctcggattgagagtgtggcagttcgtctctgccgtcctgttcagcgggatcgcaattatggctctggctttccccgaccagttatatgacgcagtatttgacggtgcacaggtaacgagcaagaccccaattcgcctgtacggaggcgctctgctgagcattagcttaatcatgtggaatgctctctacacggctgagaaggtgattattagatggacactcttaaccgaggcttgctatttcggagttcaattcctcgtcgtcacggctacactggccgaaaccgggctgatgtcatag

SEQ ID NO: 55669 - DNA, 240 bp, Artificial Sequence
  Description of Artificial Sequence: Synthetic coding sequence
atggcagctaagcagcctcctccactaatgaaaaaacactcccagacggatctggtcagcagattgaagacgagaaaaatcctcggggtggggggtgaagacgacgacggagaggtgcatagatctaaaatcagccaggtccttggaaacgaaattaagtttaccattcgcgagcccctcgggctgcgcgtttggcagtttgtatccgccgtgctgttttccgggattgccatcatgtag

SEQ ID NO: 55670 - DNA, 282 bp, Artificial Sequence
  Description of Artificial Sequence: Synthetic coding sequence
atggcagccaaacaaccaccgcctttgatgaaaaaacactcacagaccgacctggtgagtaggctcaagacacgcaagatcctgggggtgggcggagaagacgacgatggcgaggtgcaccgaagcaagatcagccaagtattaggaaatgagatcaaattcactatacgcgagccgctagggctcagggtgtggcagtttgtttccgccgtactgttctcaggtattgcaataatggctctggccttccctgatcaattgtacgatgcagtattcgattag

SEQ ID NO: 55671 - DNA, 189 bp, Artificial Sequence
  Description of Artificial Sequence: Synthetic coding sequence
atggcagccaaacaaccaccccctctcatgaagaagcatagccagaccgacctggtctctagactgaagacacgtaagatccttggagttggcggtgaggatgacgatggcgaagtgcaccgcagcaagattagtcaggttctagggaatgagatcaagttcactattcgggaacctttggggctatag

SEQ ID NO: 55672 - DNA, 570 bp, Artificial Sequence
  Description of Artificial Sequence: Synthetic coding sequence
atggctgcgaagcagcctcccccactcatgaagaagcactcacagaccgatctggtgtccaggctgaaaacacgcaagattttaggagtgggcggagaggacgacgatggggaagtgcatcggtcaaaaatatctcaagttctcggcaatgagattaaattcactatcagagagcctttgggcctacgcgtgtggcagttcgtgtcggccgtcctgttttccggaatagcaattatggccctggcctttcccgatcagctctatgatgctgttttcgacggggcacaagttaccagcaaaactccaatacgcctgtatggaggcgcactcctcagtatctcgctcatcatgtggaacgccttatataccgccgaaaaggtgattatcagatggaccctgctcaccgaggcttgctattttggagtgcagttcctcgtggtgaccgcaacgctggctgagacgggcctgatgagtctcggaatactcctgctgctggtgagtcgcctcctctttgtggtcatttccatatattactactatcaggtcggaagacgccctaagaaggcatag

SEQ ID NO: 55673 - DNA, 1182 bp, Artificial Sequence
  Description of Artificial Sequence: Synthetic coding sequence
atggctccccctccccctagccctcagctgctattgctagccgctttagctcggctcctgggaccgtccgaagtcatggccggacccgctgaagaggccggagcccactgcccggagtccctgtggcctctcccccctcaggtgagtcccagggtaacctacaccagggtctctcccggtcaggcggaggatgtcacgtttttgtaccatccctgcgcgcatccctggctaaaactgcaactagctctcctcgcctacgcgtgcatggctaacccctcccttacacccgatttttcgctgacccaggaccggcctcttgtattgaccgcatggggtctggcgctagaaatggcatgggtggagcctgcttgggcggcacattggttgatgcgtaggaggcgtcggaagcagagaaaaaaaaaggcctggatttactgcgaaagcctgagcgggcctgccccttctgagcccactcctggcagggggaggctgtgcagacgcggttgtgtacaggccctggctctggcgtttgccctacggtcctggcgcccaccaggcaccgaagtgacatcccagggcccaagacagccaagctcgagcggtgccaagcggaggaggctgcgcgctgcattgggtcctcaacctacaagatccgccctaaggtttccaagtgcgagcccagggtccctgaaggctaaacaatcaatggccggtatccccggtagggagagcaacgccccaagcgtcccaacagtgagcctgctacccggagctcccggaggtaatgcctctagtagaaccgaggcgcaagtgcctaatggtcaagggtcacctggtggatgcgtctgctctagtcaggcctcacccgctcccagagccgcagctcctccccgagccgctagaggcccaactccccgtacagaagaagccgcttgggccgcaatggcgctgacctttctcttagtgctcttgactctagccaccttgtgcactcgattgcatcggaattttcggagaggtgaatctatctactgggggccaaccgcggattcgcaggacactgttgccgcagtccttaagcggagactgctgcagcccagtcgcagggtaaagagatcccgcagaagacccctgctccctccaactcccgatagtggcccagagggcgaatcttcagagtag

SEQ ID NO: 55674 - DNA, 414 bp, Artificial Sequence
  Description of Artificial Sequence: Synthetic coding sequence
gctaaacagagcatggccggaatccctggcagggaatcaaatgcccctagcgtccccacggtgagtctattgcccggagccccagggggaaacgcttcatcgcgcaccgaggcccaggtgcccaatgggcagggccctcggggactgtgcttgtttaagtcaggatttccaggacccagccgtagctcaccacgggcagccagagggccaacccctcgaacggaagaggccgcttgggccgcaatggctctgacttttttgctggtactgttgactttagcaaccctgtgcacacgtttgcatcgaaatttcagaaggggggagagtatctactgggggccaaccgccgactcccaagatacaacaccacctcctgctcacgacagcgggcctgaaggcgagtctagcgagtag

SEQ ID NO: 55675 - DNA, 1605 bp, Artificial Sequence
  Description of Artificial Sequence: Synthetic coding sequence
atgcaagccgctagggtcgactatattgccccttggtgggtggtgtggttacactccgtccctcatgtcggactacgacttcagcccgtcaactccactttctctccaggagacgaatcttaccaagaatctctccttttcctgggcctggtggcagccgtctgtctggggctgaacctgattttcctcgtggcctatttagtctgtgcttgtcactgtcgcagggacgacgccgtacaaacaaagcagcatcatagctgctgtatcacttggacagcagtggtagctggcctgatttgttgtgctgcagttggagtagggttctacgggaactcagaaacaaacgatggagcatatcaattgatgtactccttggatgatgccaaccacacgtttagcgggatagacgctcttgtgtctggtaccacccagaaaatgaaagtggatctcgagcagcacctggccagactgtccgagatatttgccgcacgtggcgattacctgcagactctgaaatttatccagcagatggctggaagcgtcgtggtgcaactgtccgggctccctgtctggagggaagtgactatggagctgactaagctgtcagaccagactggatatgttgaatattaccggtggctgtcctatcttctgctgttcatcctggacttagtaatctgccttatcgcctgcctggggctggccaaaagatcgaaatgtctgcttgcaagtatgctgtgttgcggggctttgtcgctgttattaagctgggcctctctcgccgcagacggttcagctgctgtagctaccagtgacttctgcgttgccccagatacctttatacttaatgtcactgaggggcagatctcaacagaggtgactaggtattatctgtactgcagccaaagcggaagttctccctttcaacaaactttgactactttccagcgcgcactgacaacaatgcagattcaggtggccggactgctgcaattcgcagtgcctctgttctccacggctgaagaagatctgcttgcaatccagctcttgcttaattccagtgagagcagcctgcaccagctcaccgcaatggtcgattgtagaggtctgcacaaggactatctggatgcattggcgggtatatgttatgacggtttacaagggctgctgtacctgggactgtttagtttcctggccgctctcgcattctctacaatgatctgtgctggaccacgggcttggaagcatttcaccacccggaatagagattacgatgacatagacgacgatgatccatttaacccacaagcttggcgtatggccgctcattctcctccgaggggtcaactgcattccttctgttcatattcctcgggcctagggtcacagacctcgctgcagcctcccgctcagacaatttctaatgccccagtcagtgaatacatgaatcaagccatgctttttgggagaaacccaaggtatgaaaacgttcctctaattggccgtgccagtccacctccgacctattctccaagtatgcgggcaacctacctgagcgttgccgatgagcacctgcgccactacgggaaccaattcccggcatag

SEQ ID NO: 55676 - DNA, 642 bp, Artificial Sequence
  Description of Artificial Sequence: Synthetic coding sequence
atgcaaatccaggttgccggattgctgcagttcgcagtccccttgttctccactgccgaggaagacctcttggcaatccaactgctgttaaacagttctgaatcatccctgcaccagcttactgccatggtggactgtcggggtctacacaaagattacttagatgcactcgcaggaatctgctatgatggcttgcaggggcttttgtatttaggtctgttctccttcctggccgcactcgctttttctaccatgatttgcgctggtcccagggcctggaagcatttcaccacacggaacagggattatgatgacatcgacgatgatgatcctttcaaccctcaagcatggaggatggccgcacactctccccctcgcggtcagctgcatagtttctgctcttactcctcaggactcggttcacagacttccctgcaaccccctgctcaaaccatctcaaacgcacccgtcagcgaatacatgaatcaagctatgctttttggacgtaatcctcgctatgagaacgtccccctgattgggagggcttcaccccctcctacatactcgccgtctatgcgggcaacttacctctccgtggccgatgagcatttacgccactatgggaatcagttccctgcctag

SEQ ID NO: 55677 - DNA, 1572 bp, Artificial Sequence
  Description of Artificial Sequence: Synthetic coding sequence
atggcaggagtatcatacgcagcaccatggtgggtgagcctcctccatcgcctcccccattttgatttgtcttgggaagccaccagttctcagttccgacccgaagacacggactatcaacaggccctgctgctgctgggcgcagccgctctagcctgtcttgctcttgacctgctattcctccttttttattcattctggttgtgctgcagacgtagaaaatcggaagagcatctcgacgctgactgttgctgcaccgcctggtgcgtgattattgctacccttgtgtgttccgctggaattgccgtcggcttctacggcaacggtgagacaagcgacggcatacacagggccacttactctctgcgtcacgctaaccggacggtggctggtgtgcaggatagagtttgggacactgccgttggcctcaatcacactgcagaaccatctcttcagactctggagagacagttggccggtaggcccgaacccctgcgagccgtgcagaggctgcagggcctcctggagacactgctgggctacactgccgctatcccgttctggcggaataccgcagtcagcctagaagtgctcgccgaacaggtggacctgtacgattggtaccgatggctaggctaccttggactgctcctgcttgacgtgatcatttgtctcctggtgttggtcggcctcatccgctcctcaaaagggatacttgtgggcgtgtgcctcctcggtgtgctggcactcgttatctcctggggtgctctcggcctggaactggcggtgtccgtgggctcaagcgacttttgtgtggatcccgacgcctacgtaacaaaaatggttgaagaatattctgtgctgtcaggcgatatactccagtactacctagcctgctcaccaagggccgcaaaccccttccagcaaaaattgtcaggcagtcacaaggccctggtcgaaatgcaggacgtcgttgctgagctcctgagaacagtcccctgggagcagcctgctacaaaggatccattactgagagtgcaggaggtgttaaacgggacagaagtgaatcttcagcacttaactgctctggtggactgcagatcgctacacctggattacgttcaggcactgacgggcttctgctatgatggagttgaaggattgatttacctggcattatttagcttcgtgaccgccctcatgttctcctccatagtgtgctccgtacctcacacatggcagcagaagagggggccagatgaggacggcgaggaggaagcagctccagggccacgccaggcccatgattctctatacagagtacatatgccgtccctttacagctgcgggagctcttatggctccgagacaagcatccctgcagctgcacacacggtctcaaacgccccagtcacggagtacatgtctcaaaatgctaatttccagaatcctcgatgcgagaatacccctttaatagggagagaatcacctcccccatcttacacgagctccatgcgcgcaaaatatctggccaccagtcaaccacgcccagattctagtggaagccactag

SEQ ID NO: 55678 - DNA, 1059 bp, Artificial Sequence
  Description of Artificial Sequence: Synthetic coding sequence
atgccatccggggtgcctggctgctggcctcaactaccactaaagggtccatggcgtcccactccccgaccccgagtccccgtgccatggcgaacaccacgcttcgcatgcaggtggctcggctatctggggctattgctgcttgatgtgattatctgcctgctggtgctcgtcggcctcatcaggagctcaaagggtatcctcgtgggcgtgtgcctgctcggagttttggccctcgttatatcatggggggcactcggactagaactagcagtgagtgtaggttcgtccgatttctgtgttgatcccgacgcctatgtgaccaagatggtggaggagtattcagtgcttagcggagatatcctgcaatattatttggcttgctctcccagggcggctaacccgtttcagcaaaaactctcagggagccacaaagcgttggttgaaatgcaagacgtggtcgccgagctcttgcggactgttccatgggaacagcccgcaacaaaagaccccctcctgagggtgcaggaagtcttgaacggcaccgaagttaatctgcagcatcttacggcattagttgattgtcgcagtctccacctcgactatgtccaggccctgaccggtttctgttacgacggcgtggagggactgatctacttagccctgttttcctttgtgacagccctcatgtttagctctattgtgtgctccgtcccccacacctggcagcagaaacggggaccggatgaagacggagaggaggaggcagctcctggccctagacaagcgcatgattctctgtaccgggtgcacatgccgtccttatacagttgtggaagttcatatgggagcgaaaccagcatccctgcagccgctcacaccgtctcaaacgccccagtcacagagtatatgtcccagaacgccaatttccagaacccacgctgtgaaaatacacctttgatcgggagggaatcccctcctccctcctacactagctccatgcgtgccaagtacctggccacttcccagccacgcccagattcttcaggttcacattag

SEQ ID NO: 55679 - DNA, 1476 bp, Artificial Sequence
  Description of Artificial Sequence: Synthetic coding sequence
atggcaggggtgtcttacgctgcaccttggtgggtttccttactgcaccggctgccacactttgatctgagctgggaggccaccagctcacagtttcgtccagaagatacagactatcagcaagcattactactgttgggagcggctgcactggcgtgtttggcgctggacctgctgttcctgctgttctattccttttggttgtgttgtagacggaggaaatcagaagagcacctcgacgctgattgttgctgcaccgcctggtgtgtgataatcgcgacgctagtgtgcagcgccggaattgctgtaggattttacggcaatggcgaaaccagcgacggaatccatagggccacttactctctgcgtcatgcaaaccgaaccgttgctggagtacaggatagagtgtgggatacggccgtggggttgaaccacaccgctgaaccatccttgcagaccttagagagacaactcgcgggaaggcctgaacccttgcgcgcagtgcagcgattgcaagggctgctggaaaccttactgggatacactgccgcaatcccgttctggcgcaatactgccgtctcactggaggtcttggccgagcaggttgacctgtatgattggtatagagtgtgtctgctcggtgttctagcactggtgataagttggggggcattaggtttagagctcgctgtgagtgtgggctcatcagacttctgtgtggaccccgacgcttacgtaaccaagatggtggaggagtactctgtgctctccggcgacatactgcagtactacctggcctgtagtccgcgtgcggctaatccctttcagcagaagttgtctgggtctcacaaagctctggtcgagatgcaggatgtcgtggcggaactgctgcgcacggtgccctgggagcagccggctaccaaggatccgctgctcagggtgcaggaagtgctcaacgggacagaagtgaatctgcagcatctcaccgcactggtagattgcagatcacttcaccttgactatgtgcaggccttgaccggattctgttacgacggagtagaggggctcatctacctcgccctgttctccttcgtcaccgccctgatgttttcctctattgtgtgtagtgtgcctcatacttggcagcaaaaacgcggtcccgatgaggatggcgaggaggaagccgctcccggtccgagacaggcccacgacagtctctatcgggtacatatgccctctctctacagctgcggctcatcttacggctccgagaccagcatccccgcagccgcacataccgtgtccaacgctcccgttactgagtacatgagccagaacgctaactttcagaatcctcgatgtgagaatacaccactgatcggtcgcgaatcccccccaccctcttatacttccagcatgcgggctaaatacctggctacaagtcagcccagacctgatagttctggttcccattag

SEQ ID NO: 55680 - DNA, 609 bp, Artificial Sequence
  Description of Artificial Sequence: Synthetic coding sequence
atggcagaatatctggcatccatttttgggacagagaaagataaggtaaactgtagcttttatttcaagattggggtgtgtagacatggggatcgctgttctaggctgcacaacaagcccacctttagtcaagaggtatttaccgagctgcaggagaaatatggggagattgaagagatgaacgtgtgcgacaatttaggagaccacttggtaggcaacgtttacgtgaagttccgaagggaggaagatggtgaacgcgctgtcgcagagcttagtaacaggtggtttaacgggcaggctgtccatgggaatgtgcccgaagttgcttctgccacaagttgcatctgcgggccttttccaaggaccagccggggatcgtccatgggaggtgaccctggcgctggtcatccaaggggaagcatcctcgccacaatccctgaaagagggaccattggagtgccgcttatcaccggaatggcagctagcgaggccctagcccctctgcctttcacaccaaacagggaccggtgcagctggcaagacttaagctccaaacctccatcacttagctgtccaattctacctcgcctgccaggctctattatgtag

SEQ ID NO: 55681 - DNA, 546 bp, Artificial Sequence
  Description of Artificial Sequence: Synthetic coding sequence
atggctgagtacctcgctagtatcttcggaaccgagaaagacaaggttaattgcagcttttattttaaaatcggcgtatgtagacatggcgatcggtgttccagactgcacaataagcccaccttcagccaggaggtgttcacagagttacaagaaaaatacggcgaaattgaggaaatgaatgtctgtgataatctgggtgaccatctggtggggaatgtttacgtgaagttccggagagaagaagatggcgagcgggctgttgcagagctttcaaatcgctggtttaacgggcaggccgtccacggcgagctgtcccccgtaacagatttccgggagagctgctgccggcagtacgagatgggcgaatgcactcggggtgggttttgcaacttcatgcacctccgccctatctcacaaaatctgcagcgtcaactgtatggacgagggcctcggagacgaagcccgccacggttccatacagggcaccatccacgtgagagaaatcatagatgtagcccagatcattggcacggcaggttttag

SEQ ID NO: 55682 - DNA, 552 bp, Artificial Sequence
  Description of Artificial Sequence: Synthetic coding sequence
atgtgtgcgactactcttggtacaactagttgggcaacgtctatgtcttcctcgggaggcagaaggatggagtcaggaccctggcttaattcagtcaccgccggtagtactgggaggctgtgtaccggaatgtatccgagatggttattgcaactccacgcgtctgcagcccatttccctgaaccacccgaggccgcattgtgggcagggactcaagcacaggtgccacaggatcagcctgccatgtcaccgcacgtgctgaggcccctatacccccagatgtcactcacactgagtccctctaaccatgtgcctaaaaactttttctttttcttcttcttcgagatggaacctcacagtgtcgcacaagccggagtgcactggcatcacctaggaagttggcagctgccaccgccaggatttaaacagttctctgcctccgcatcacagatcgccggaatcaccggcacctgccaccatgctagattgatcttcgtgttcctggttgagatgggttttcatcacctcggccaagcaggtctgaatagttag

SEQ ID NO: 55683 - DNA, 663 bp, Artificial Sequence
  Description of Artificial Sequence: Synthetic coding sequence
atggccgaatacctggctagtatcttcggtaccgagaaagataaagtaaactgcagcttttattttaagatcggcgtgtgcaggcatggcgaccgttgcagcagactgcacaacaaacctacgttctctcagaccattgtgttgcttaacctttaccggaatccacaaaataccgctcaaaccgcggatggatctcattgccacgtgtctgacgtggaggtgcaagaacactacgactccttcttcgaggaggtgtttaccgagcttcaagagaaatatggcgaaattgaggaaatgaacgtctgcgataacctcggcgatcacctggttggcaacgtttatgtgaaattccgtagagaggaggatggagagagggcggtggcggagctgtcgaacaggtggttcaacgggcaagcggtacatggcgaattgagtcccgtgaccgactttagggagtcatgctgccgccaatatgagatgggagaatgcactcggggaggattctgtaattttatgcacctgagacccatctcacaaaacctgcagcgacagctgtacggaagaggccctcgtcggagaagcccacctaggttccatactggccaccaccccagggaaagaaatcaccgttgcagtcccgatcactggcacggcaggttctag

SEQ ID NO: 55684 - DNA, 930 bp, Artificial Sequence
  Description of Artificial Sequence: Synthetic coding sequence
atgtgtttcttcttcagtctgcaagaagagttcctggataaacatactctgatgcgagtgctctcaagtgggggaaagctgggaagtaggggggaaggtgcccagttgtgttgctggatgctcctctttagttggcgcgtatcgggagggcaacagacgcggcgactatgtagacgagctttctgctggtcacccgtcccgtctcccagctgctccccttcctcctgtctgacagctcggagtagtctgtgcatgactttcacacagtcaaggaccactagctcacttgctccggtcttcgccctgtttgtccccttttattgttcaatcccgagagtgcaagtggctcagatcttgggtcctctgtccatcaccaataaaaccctgatctatatactcgggctgcagctgttcacctctggtagctatatctggatcgtggcaataagcggcctgatgagcggcctgtgctacgatagtaagatgttccaggttcaccaggttctttgtattccatcttggatggcgaaattttttagttggactctggaacccatcttcagttcatcagaacccaccagcgaggcaagaatcggaatgggggctaccctagacatccagcgccagcaaagaatggagctgttggataggcaactgatgttctctcagttcgctcagggcaggagacagagacagcaacaaggaggcatgatcaactggaatcggctgtttccaccacttcgccagcgccagaacgtgaattaccaggggggtcgccagagcgagccggcagccccacccctggaagtgtctgaggagcaggtggcccgactgatggagatggggtttagcaggggggatgctttagaggcgctgagagcctcaaacaacgacttaaatgtggccactaactttctgcttcagcattag

SEQ ID NO: 55685 - DNA, 1035 bp, Artificial Sequence
  Description of Artificial Sequence: Synthetic coding sequence
atgttcaccagcacggggtcatctggtttgtacaaagccccactgagcaagagcctgctcttggttcccagtgccctctccctcctgctggcgcttctactgcctcattgccaaaagttgtttgtctacgatctgcacgcagtcaagaatgactttcagatctggagattgatctgcgggagaataatctgtctcgatttaaaagatacattttgtagctcccttctcatttataattttaggatatttgagaggaggtacgggagcagaaaatttgcatcgttcctgctaggcagctgggtgctgtcagccctctttgactttttgctcatcgaagccatgcagtacttctttggaattacagctgcttctaaccttccttcgggattcctggccccagttttcgctctttttgtacccttctactgttctatcccacgtgtccaggtggctcagatcttggggcctcttagcatcaccaataaaaccctaatatatattctcggcctacagctcttcacaagcggctcatatatctggattgtggccatttccggcctgatgtcaggtctctgttatgactctaaaatgtttcaggtccatcaggtgctctgcatccccagttggatggctaagtttttttcctggaccctagagcccatatttagctcatccgagccgacgtcagaggcacgcatcggaatgggagcaacgctggatatccagagacagcagcgaatggagctgctggaccgtcaactgatgtttagtcagtttgcacagggacgtcggcaaagacagcagcagggtggcatgattaattggaatcgcctgttccctcccctacgccaacgccagaacgttaactatcaaggcggtcgccagagtgagcccgctgcccctccattagaagtgtccgaggaacaggtcgctcgcctgatggaaatgggcttttctcggggagatgcactcgaggcccttcgggcttctaacaatgatttgaatgtggccaccaactttctgttgcaacactag

SEQ ID NO: 55686 - DNA, 192 bp, Artificial Sequence
  Description of Artificial Sequence: Synthetic coding sequence
atggctgctgcgaccctcacgtccaaattgtatagtcttcttttccggcgaacaagtacattcgccttaacaatcatcgtgggcgtcatgttttttgaacgggcttttgatcagggtgccgatgcgatttacgaccatatcaatgaggggaaactgtggaagcatattaagcataaatacgaaaacaaatag

SEQ ID NO: 55687 - DNA, 399 bp, Artificial Sequence
  Description of Artificial Sequence: Synthetic coding sequence
atggccgctgcgaccttaacatccaaactgtattccctgctctttcgtcgtccccctcctagccccagcccaagtagctgggcaagttgttcaagttccgcccctagcatcaaggcacgaacactgtcaacgactaccagtacgaggggtagctgtggtaatacatcatcgacatctatgcggacaagcagcagcttagaggcccctattcaagcacggcgaaccagatcaacacagcagctctttgcccagtcctggtcactctctcttaagatgatgctgaaagtgctgtttatggaccatcattcactgctggctagaaatggattcacatacaagactgactccttgcctagcgcggtgtttgaagtgtgtttggtaagcatgcttcgtaagtag

SEQ ID NO: 55688 - DNA, 189 bp, Artificial Sequence
  Description of Artificial Sequence: Synthetic coding sequence
atggcagcggcaactctgacttcaaagctgtattcgttactgtttcgcagaacttcaaccttcgctcttaccatcatagtgggcgttatgtttttcgagagggcctttgaccagggcgctgatgcaatatatgaccatattaatgagggggtaagggcctgcgcaatcccagatcttggacccgcatag

SEQ ID NO: 55689 - DNA, 249 bp, Artificial Sequence
  Description of Artificial Sequence: Synthetic coding sequence
atggctgcagctaccttgactagtaagctctacagcctgctgttccgtcgaaccagtaccttcgcactcaccatcattgtgggagtgatgttctttgagcgggctttcgatcaaggggctgatgctatctatgaccacataaacgaaggcgtgagagcatgcgcaatccctccttggacccgccttaggggggacagcggcgtagaaaaactgtggaaacatatcaaacacaagtatgagaacaagtag

SEQ ID NO: 55690 - DNA, 171 bp, Artificial Sequence
  Description of Artificial Sequence: Synthetic coding sequence
atggtgaccaggttcctgggcccaaggtatagggagttggtgaagaactgggtccctacagcctacacttggggcgcagtcggtgccgtgggcctcgtgtgggctaccgactggagactaatcctggactgggtcccatatatcaatggcaaattcaaaaaagataattag

SEQ ID NO: 55691 - DNA, 15531 bp, Artificial Sequence
  Description of Artificial Sequence: Synthetic coding sequence
atggctaccagcggtggggaggaggcagcggctgccgctcccgctccagggacccctgccacgggcgcagacactacccccggttgggaagtcgccgtacggcctctactgagtgcttcttactctgcattcgaaatgaaagagctgccgcagctggtcgcttccgttattgaatccgaaagcgaaatcctgcaccacgagaagcaatacgagcccttttattcctcttttgtggccctgagcacccactacatcactactgtgtgctccctgattccgcgaaatcagctccagtccgtggccgctgcgtgcaaagtgctaatagagtttagcctgctgaggcttgaaaatcctgatgaagcgtgcgcagtgagccaaaaacaccttatcctcctcatcaagggtctgtgtacgggctgctcgcgcctggaccgaactgagattattacatttactgcaatgatgaagagcgcaaagctcccacagaccgtcaagaccctcagcgacgtcgaggaccagaaggagctcgcctctcctgttagcccggagctgcggcagaaggaggtgcagatgaacttcctgaatcagctgacctctgtgttcaatcccagaactgtggcctcgcagcctatttcaactcagacactggtggagggcgaaaacgatgagcaatcatccaccgatcaagccagtgctattaaaacgaaaaacgtgttcattgcacagaatgtcgctagcctgcaggaactgggtggttcagaaaaactgctgagagtctgtcttaacctgccatactttctgaggtacatcaaccggttccaggacgcagtcctggctaacagcttctttatcatgcctgccacggttgcagacgcaacggccgtgcgtaatgggttccactctctggtgattgacgtcacaatggctctcgatacactgagccttccagtattggagcctctgaatcccagcagacttcaagacgttaccgtgctgtccctttcctgcttgtatgccggtgtgagcgtggctacgtgtatggccattctccacgtgggttctgcccaacaggtcagaactggctcaactagctccaaagaggacgattacgagagtgacgctgcaacaatcgtccagaaatgtttggagatttatgatatgattggccaggcgatatcctcttctagacgcgctggaggtgagcactaccagaactttcagctcctgggcgcatggtgcctcctgaacagcctgttcctgattctcaacctatcacccaccgcgctcgctgacaaggggaaggaaaaggacccactggcggcattacgggtgcgagatatcctcagtcgaaccaaggagggcgtcgggtcacccaagcttggcccaggaaagggccatcagggatttggagtcttgtctgtgatcctcgctaatcacgccattaagttacttacttcattgttccaggacctgcaggtggaggcgctccacaaggggtgggaaaccgacggcccacctgccgctcttagcatcatggcccagtccacttccatacagaggattcagcgtctgattgattccgttcctctgatgaacctgctgctaacactcctttccacctcttacagaaaggcttgtgttctgcagcgccaacgcaagggcagcatgagctccgacgcaagcgccagcactgattccaacacatactacgaggatgacttctcgtccactgaagaggactcctctcaggatgatgacagtgaaccgatactcggtcagtggttcgaagagaccatttccccatcaaaagagaaagcggcaccacctcccccacctcccccaccccctttggagtcatcgccccgagtgaaaagccccagcaaacaggccccaggggaaaagggaaacattctggcgtcacggaaggacccagagttgtttttgggcctggcgagcaatatacttaattttatcacgtcctcgatgctcaactcgcgcaacaatttcattagaaactacctgagcgtgtccctgagtgaacaccacatggctaccttggccagtattatcaaggaagtggataaagatggcctgaaggggagttcagacgaggagttcgctgcagcgttatatcacttcaaccactcgttagtgacctctgatcttcagagtcctaaccttcagaataccttattgcaacagttgggggttgcaccattctcagagggcccttggcccctgtatattcatccccagagcttatctgtgcttagccggttgctcttgatctggcagcacaaagcttctgctcagggcgatcctgatgtgcccgaatgcctcaaagtttgggacagattcctgtcaacaatgaaacagaacgcacttcaaggtgttgtcccttctgaaaccgaggacctgaatgtggaacatctacagatgctattacttattttccacaactttacagagaccggtcgacgggcaatcctttctctgtttgttcagattatccaggaactgtcggtcaacatggacgcccaaatgaggttcgtgccccttatacttgccagacttctgctcatatttgactacctgcttcatcagtacagtaaggcaccggtctacttattcgaacaagtgcaacacaacctgctcagccccccttttggctgggcctccggatctcaagatagcaattcaaggagagccacaacacctctgtaccatggcttcaaggaggtggaggaaaattggagcaaacacttctctagcgatgccgtgcctcaccctcggttctattgtgtgctctccccggaggcttcagaagatgatctgaacagactggattcagtcgcctgcgacgtgttgttttccaagcttgtgaaatacgacgagctgtacgctgctctgactgctctcctcgctgccggaagccagcttgataccgttaggagaaaggagaacaagaatgtaaccgccctggaggcctgcgctctgcagtactattttcttattctgtggcgaatactaggcattctccctccgtccaagacctacataaaccagctgtccatgaacagccccgaaatgagtgaatgcgacatactccacaccttgcggtggtcaagccggctgagaatttcttcttatgtgaattggattaaggaccacctgattaagcagggcatgaaggcagagcacgcaagttccctgctagagctggccagcacaaccaaatgttcctcagtgaagtacgacgtggagatcgtcgaagagtatttcgctcgtcagatttcttcattctgtagcatcgactgtacaacaattctgcagcttcacgaaattccgtctctccagtctatttatactctggacgccgctattagtaaggtgcaggtgtctctggacgaacatttctctaagatggccgcagaaaccgatccacacaaatcttcagagattactaagaatctgctgcctgctacccttcaactcatcgatacttatgcatccttcacacgggcttacctcctgcagaactttaatgaggagggtacaaccgagaaaccctcaaaggagaagttgcagggctttgctgccgtcctggccattggctcctcccgatgcaaggcaaacaccctcggcccaacattagtccagaacctgccctcttctgttcaaacagtttgcgaaagctggaacaatatcaataccaacgagtttcccaacatcggaagttggaggaacgcatttgctaacgacacaattccctcggagtcttatatctctgcagtacaagccgcacacctgggaaccctctgtagccagagccttcccctagccgctagcttgaaacataccctcctcagccttgtaaggttaacgggagacctgatcgtctggtcagacgaaatgaacccaccccaggtgatcaggaccctgctgcctctcttactcgaatcatctacagaaagtgtcgcagagatctccagcaattcccttgagcgcatcctgggcccagctgagtccgacgagttcctcgctagagtctatgaaaagttgataacagggtgttataacatcctggctaatcacgcagacccaaattcaggcctagacgagtccattctcgaggagtgcctgcagtatcttgagaaacagttggagagttctcaagcccgaaaagctatggaggagttcttctcggacagcggcgagttagtgcagattatgatggccactgctaacgaaaatttgtcagcaaaattttgcaaccgggtgctcaaattctttaccaagttattccagctgacggagaagagcccgaaccccagtctgcttcacctgtgtgggtccctggcacagctggcctgtgtagagcctgtgaggctgcaggcttggctcacccggatgacaacttcaccccctaaagacagcgatcagctggatgtaattcaggagaaccggcagctgttgcagctgctcacgacttacatcgtcagagagaattctcaagttggcgaaggcgtctgcgctgtgttactgggtaccttgacaccgatggccacagaaatgttggccaatggcgatggcacgggctttcctgagctgatggtcgtgatggctaccctggcatccgccggtcagggcgctggacatctgcagcttcacaacgcagcagtggattggctgagcagatgtaagaaatatttgagccagaagaatgtggtagaaaagctgaacgccaatgtcatgcacggaaaacacgtgatgattctcgagtgcacctgtcatattatgtcctacttggccgacgtgactaacgctttatctcagtccaatggacaaggcccaagccacctttcggtggatggcgaagagcgggctattgaggtggatagcgattgggtggaagagttggcagtcgaggaggaggactcccaggctgaagactctgacgaagactctctatgcaacaagctttgtacttttacaatcacacaaaaggagttcatgaaccagcattggtaccactgccacacctgtaagatggtggacggcgtaggggtgtgcaccgtctgcgccaaggtgtgtcataaggaccacgaaatatcatatgctaagtacggcagtttcttctgcgattgtggggctaaggaggatgggagctgtctggccctggtgaaacgaactccctcttcgggaatgagttccacaatgaaggagtccgccttccagtcagaacctcggatcagcgagtcactggttcgccacgcctcgacttcatcgcctgcggataaggccaaagtgactatatccgacggaaaagtcgctgacgaggaaaagcccaaaaagtccagcctgtgccggaccgtcgaggggtgtagagaggagttacaaaaccaagcgaattttagcttcgcaccactggttctggatatgttgaactttctgatggacgcaattcagaccaacttccaacaagcctctgctgtgggatcatcgtcgcgcgctcagcaagccctttctgaactgcacactgttgagaaagctgtggaaatgaccgatcaattgatggtgccaaccctgggttcacaggaaggtgcgtttgaaaacgtccgcatgaactactccggtgatcagggacagactattcgccagctaatctcggcccacgttctaaggagggtcgccatgtgcgtcctctcctcccctcacgggaggcgacagcatcttgctgtgagtcacgaaaagggtaaaattaccgtgttacagctctctgcattgctgaagcaggctgactcttcgaaacggaagctgacgttgaccaggctcgcaagtgcaccagtgcctttcaccgttctgagcctgacaggcaatccctgtaaggaggattatctggcagtttgtggcctgaaggattgccatgtgcttactttttcctcctccggttccgtgtctgaccatcttgtgctccaccctcagctcgccacgggtaacttcataattaaggcagtatggctccctgggtctcagaccgagctggcgatagtgaccgccgatttcgttaagatctatgacctttgcgtggatgccctgtcacctactttctattttctcctgcccagctctaaaatacgagacgtgacttttctgttcaacgaggagggtaagaatataatcgtcattatgtctagcgcaggctacatatacacacaactgatggaagaagcttccagcgcacagcaggggccattttacgtgactaatgtgttggagataaaccacgaggatctgaaagattccaattctcaggtggcaggaggcggtgtatctgtgtactacagccacgtgttgcaaatgctgttcttcagctattgccaggggaagtctttcgcagccacaataagcaggacgacgcttgaagttctacagctattccccattaatataaagtcgtctaatggaggaagcaagacgtcacccgcactctgccagtggtctgaagtgatgaaccaccctggactcgtgtgctgcgttcagcagaccaccggagtgccgttggtagtgatggtcaagcccgatacctttctgattcaggagatcaagacattaccagccaaggcaaaaatccaagacatggttgcgatccggcatactgcctgtaatgagcagcaaaggactacgatgattttgttatgcgaggatggttctctgaggatttacatggctaacgtcgaaaatacaagttattggctgcaaccaagtctgcagccttcctcagtaatctctataatgaagccagtccgaaagcgcaaaactgcaaccatcacaacacgcactagttctcaggtcacatttcctatagatttcttcgaacataaccaacagctcaccgatgtggaatttgggggtaatgatctgctgcaggtgtacaacgctcagcagataaagcaccgactgaactccacaggcatgtacgtcgccaacaccaagccgggaggattcactatcgagatcagcaataacaacagcactatggtgatgaccggtatgcgaatccagattggaactcaagctattgagagagcgccatcatacattgagatttttggaagaaccatgcagctgaatttatctcggagtcggtggtttgacttcccgtttacaagagaggaggctctgcaggctgataagaaactcaacttgttcattggagcttctgtggaccctgctggagttaccatgattgacgccgtgaagatctacggtaaaacaaaagaacagtttggatggcccgacgagccacctgaagagttcccctccgcctccgtgtcgaacatttgtccttctaatcttaaccaaagcaatggaacaggcgattccgactctgctgcccctaccacaacaagtggaactgtgctcgagcgtctagttgtaagcagtctcgaggcattggaatcctgttttgctgtggggccaatcatcgagaaagagcgaaataaaaacgcggcacaagaacttgcgacattactgctctcactacctgctcccgcttccgttcagcagcagagtaagagtctactggctagtctgcatactagtaggagcgcctatcacagtcacaaggaccaagctctcttgtccaaagcagttcagtgtttgaatacttcctccaaggaaggcaaagatttggatcccgaagtgtttcagagactggttatcactgctagaagtattgctataatgcgtccgaacaacctggtgcattttacagagtctaagctgccgcagatggagactgattgcttcttccctcggtgcgcctgttggtcactgggcattgtcggtatactcatcggggcaccattggaaacaccctcacctgaaggtatggatgagggcaaagagcctcaaaaacagctcgaaggcgactgttgcagcttcatcacacagctggtcaatcatttctggaagcttcacgctagcaagcccaaaaatgcttttttagctccagcctgcttgccgggactaacacacattgaagccactgtgaatgctctggttgatataattcacgggtactgcacctgtgagttggactgcattaatactgcttctaaaatttacatgcagatgctcctgtgccctgaccctgcagtgtcgttctcttgtaaacaggcactgattcgagtgctcaggccccgtaacaagcgacgccatgttactttgccctccagcccaaggtcaaatacaccaatgggagataaagatgacgacgacgacgatgacgccgatgaaaagatgcagtcttcaggaattcctaacgggggtcatattagacaggagtcccaagagcagtctgaggtggatcatggcgattttgaaatggtgtcagagtcaatggtgctagagaccgcagaaaatgtaaacaatggcaacccctcgcccctggaggctcttttggccggtgctgaaggttttccccctatgctggatatcccccctgatgccgatgatgaaactatggtcgagctcgctattgccctttctctccagcaggatcaacaggcacccgctagtgacgacgagggtagcactgccgctacggatggttccacattgagaacatcaccggcagaccacggagggtccgtcggatctgaatcgggaggcagcgcagtagacagcgtcgccggagaacacagtgtgtctggccgatcctccgcctacggggacgccactgccgaaggtcatcccgcaggaccgggatcggtctcctccagtaccggtgcaatctccaccaccacaggccatcaggagggagatggttccgaaggcgaaggcgaaggagagaccgagggagatgtgcacacaagcaacaggttacacatggtgcgcctgatgttgctggaaagattgctgcaaacacttcctcagctgaggaacgtggggggtgtccgagccatcccttacatgcaggttattctgatgttgaccactgacttggacggcgaggatgaaaaggataaaggcgcattggataacctgcttagccaattaatcgccgagctggggatggacaaaaaggatgtgtccaagaagaacgaaaggagtgccttgaacgaagtgcacttggtggttatgagactgctgtccgtatttatgtcaagaaccaagtcaggctcaaagtcaagcatatgtgagagttcctctctgatttcctcagccaccgctgcagcgttgttgagctccggtgctgtagattactgcctgcatgtgctgaagagcctgctcgagtactggaaatcccaacaaaacgatgaggaacctgtcgctacttcccagttattgaagccacacaccaccagtagtcctcctgacatgagccctttcttcctccggcagtacgttaaggggcacgctgctgatgtgtttgaagcttacacacagttgctcactgaaatggtgcttcgcctgccataccagattaaaaagataacagacacaaattcccggattcctcctccagtgtttgaccattcctggttctactttctcagcgagtatctgatgatacagcagacgcccttcgtaagaagacaggtcagaaaactgctgctttttatctgtgggagcaaagaaaagtacagacagctgcgagacttacacactctggattcccacgtgcgcggtattaagaaactgctagaagagcagggtatatttttgagagcgtcggtggtgactgcatccagcggctcagcgttgcaatacgacacacttattagtctcatggaacacctaaaggcctgtgccgagatcgccgcacaacgcactatcaattggcagaaattttgtataaaagacgatagcgtgctatattttctgcttcaggtaagttttttagttgatgaaggcgtctcgccggtgctgctgcagctactttcctgtgccttgtgcgggtccaaggtcctcgccgcactagctgcctccagcggctcctccagtgccagctcatctagcgccccagtggcggcaagttctggccaggcaacaacgcagagcaaatcaagcacaaaaaagagcaaaaaagaagaaaaggaaaaagagaaagatggtgaaacctctggctcacaggaggaccaactttgcacagcccttgtgaatcaactaaacaagttcgcagataaagaaacccttatccagttcctacgctgttttctgctcgagagcaactctagttccgtgagatggcaggctcattgcctgaccctacatatctacagaaacagttctaagtcacagcaagagctcctgctggatctcatgtggagtatctggccagaactccccgcatatggccgaaaagctgcccagttcgtggatcttctggggtacttctctctgaaaaccccacagaccgagaagaaactgaaggaatattcccagaaggccgtagagattctgagaactcaaaaccatatcctcaccaaccatcccaactcgaatatctataatacactgtctggcctagtggagttcgatgggtactacctggagtcagatccctgtttggtttgcaacaatcctgaggttccattctgttacataaaactgagcagtatcaaggtggatacccgatacactaccacccagcaggtggtcaagctcatcgggtctcatacaatttcaaaggtcaccgtgaagattggggacctgaaacgcacgaaaatggtgcgcactatcaacttgtactacaacaataggacagttcaggccatcgttgaactaaaaaacaagccagctaggtggcacaaagccaagaaagtgcaactgacccccggacagacagaagtgaagatagacctgccactcccaatcgtagcttctaacctcatgatcgaattcgccgatttctacgaaaattatcaggcaagcacagaaactctgcagtgtccacgttgctcggcttccgtgccagcaaaccccggagtgtgtgggaattgtggagagaacgtttatcagtgtcacaaatgccgcagcatcaattatgacgaaaaagatccctttttgtgtaacgcctgcgggttctgtaagtacgcccgttttgactttatgctgtacgcgaaaccatgctgcgctgtcgacccaatagaaaacgaggaggatcgtaaaaaagctgtgagtaacattaacaccctcctggacaaggccgatagagtgtaccaccaactgatgggccaccggccacaactggagaatctcttatgcaaagtgaacgaagccgcacctgagaagcctcaagacgacagcggcacagcgggagggatttcttccaccagtgcatctgttaaccgatacatcctgcagctggcacaggagtattgcggggattgtaagaatagctttgacgagctgtcaaaaattatccagaaggtgttcgctagccgcaaagaactgctcgagtatgacctgcagcagcgtgaagccgctaccaagagttcaaggacctcggtgcagccaacatttacagcgtctcagtaccgagctttgagcgtccttgggtgtggacacaccagtagtactaaatgttatggctgcgcttctgcagtgactgagcactgtatcacactcctgcgcgcacttgctacaaatcccgcactgagacacattctggtgagccagggactcatccgagaactgtttgattataacctgaggcggggagcagccgctatgagagaagaagtcaggcagcttatgtgtcttttaaccagggataacccagaggcaacccagcaaatgaacgatctgatcattggcaaagtgtccacagcgctgaaaggccactgggctaacccagatctggcctcctctcttcagtatgagatgctgctgttaactgactcaattagcaaagaggactcttgctgggaattgcgcttgaggtgcgccctgagcctcttcctgatggccgttaacattaaaacacccgttgtggttgagaacataacgctgatgtgcctccgcatactgcagaagcttatcaagcccccagctccaacctctaagaagaacaaggatgtgccagtggaagccctgacaactgtcaagccctattgtaacgagattcacgcacaggcgcaactttggcttaaacgcgaccccaaggcttcatatgatgcctggaagaaatgcctgccaatcagaggaatagatgggaacggcaaagccccttccaaaagtgaactcagacatctctatcttactgaaaagtatgtgtggcgatggaaacagttcttgtctaggaggggtaagaggacatcccctttggacctcaaacttggacataacaattggcttcggcaggtcctgttcactcccgcaacccaggccgctcgtcaggctgcatgtaccattgtcgaagcattggcaaccatccctagtagaaagcagcaggttctcgacttgttaacctcgtacttggatgagctgtctattgcaggagaatgtgccgctgagtacctcgcactgtatcagaaactgattacaagtgcccattggaaggtgtacttagccgctagaggggtgttaccttacgtgggcaatctgatcaccaaagagatcgctaggctgctggccctcgaggaggccacactgagcaccgacctgcagcaagggtacgcattaaagtcattgaccggcctgctcagttccttcgtagaagtggagagtattaaacgccattttaaaagccggctggtggggacagtccttaatgggtatctgtgtctgcggaagctggttgtccagagaaccaagctcatcgatgagacacaggatatgctcctggaaatgctggaagacatgacaactggtactgagtcagagacaaaagcctttatggccgtgtgcatcgagaccgcgaagcgttacaatcttgatgactaccgaacaccggtttttatattcgagagattgtgttccattatttatccagaagagaatgaggtcacagaatttttcgtgacactggaaaaagaccctcaacaggaagacttcctgcagggcaggatgcctggaaatccttacagttcaaacgaaccagggatcggtccactgatgcgggatatcaaaaacaagatctgccaggattgcgacctcgtggccctcctggaagacgactcggggatggagcttctggttaataataagataatcagtttagacctgcccgtggctgaggtttataaaaaagtttggtgcaccacaaatgaaggcgagcccatgcgtatcgtatatcggatgagaggactgctcggcgatgccactgaagaatttattgaaagcttggatagcaccactgacgaggaggaagatgaagaagaagtgtacaagatggccggtgttatggcacaatgcggcggactggaatgcatgttaaacagactggccggaatacgggactttaaacaaggtcggcatttgctgaccgtgctcctcaagctgttttcctattgcgttaaagttaaagttaatcgccagcagcttgttaaattagaaatgaacaccctcaatgtgatgctcggcactctcaacctggcgctggtagccgagcaggagtcgaaagactccggcggtgcagctgtcgccgagcaggtactctctattatggaaattatcctcgacgaatctaatgctgaacctctcagcgaagacaaaggcaatctcctgctgacaggagataaggatcagctggttatgctgctcgaccaaatcaactccaccttcgtacggtcaaatcccagtgtacttcaagggctgctgcgaattattccctacttaagctttggagaggttgaaaaaatgcagatactggtagagcggtttaaaccatattgcaactttgacaagtacgatgaagaccactcaggtgacgacaaagtgttcctggactgcttttgtaagattgcagcgggtataaagaataatagcaatggccaccagttgaaggatctgatcttacagaaggggattactcagaatgcactggactatatgaagaagcacattccttcggcgaaaaatcttgacgcggacatttggaaaaaatttttatcccgtcccgcacttcccttcatcttacgcttattacgcggactggccatacaacaccccggaactcaagtgttaatcggaaccgactctattcccaatcttcacaagttggagcaagttagctcggacgaaggcattggtaccttggcagagaatttactcgaagctctgagagagcatccggacgtgaacaagaaaatagatgcagcacgccgtgagacaagagccgaaaagaaaaggatggccatggccatgaggcagaaggctctcggaaccctgggtatgactacaaatgagaaaggtcaggtcgtgaccaaaacggcactgctcaagcaaatggaagagctgattgaggagccaggactgacctgctgcatttgcagagaaggatacaagtttcagccaactaaggtattgggaatctatacctttactaaacgggtcgcgcttgaggaaatggagaacaaaccaagaaaacagcaagggtacagcactgtgtctcattttaatatcgtccactacgactgtcacttagccgcagtcagattggccagaggcagagaggaatgggaatccgccgcattacagaatgctaacactaaatgcaacggccttctgccagtgtggggacctcatgtgcctgaatcagctttcgcaacctgcttggctaggcataatacttacttgcaagaatgcactggccagcgggagcccacatatcaactaaatatccatgatattaaactgctgttcctgaggttcgccatggagcaaagctttagtgctgataccggaggtgggggaagggagtccaacatccatctgatcccctacataatccataccgtgctttatgtattgaacacaaccagagcaaccagccgggaggagaaaaacctccaaggcttcctcgagcagcctaaagaaaaatgggttgagtcagccttcgaggtggatgggccttattattttacagtgctcgctctacacattctgccccctgaacagtggcgggctacgcgtgtcgagatcctccggcgactactggtgacgagccaggccagggcggtcgcacctggtggggcaaccagactcactgacaaagccgtgaaggattattccgcctacagaagctcccttcttttctgggcactcgtggatcttatctataacatgttcaaaaaggtccctacgagtaataccgagggcggatggagttgctctctggccgaatacattcgacataatgacatgccgatctatgaggccgctgacaaagcgttaaaaacttttcaggaggaatttatgccggtagaaaccttctctgagttcctcgacgtggccggtctcttatctgagattaccgacccggagtcttttctaaaggacctcctcaattcggtgccctaa

SEQ ID NO: 55692 - DNA, 639 bp, Artificial Sequence
  Description of Artificial Sequence: Synthetic coding sequence
atggtcaggaccattaacctgtattacaacaaccggaccgtgcaagccatagtggagctgaagaacaagcccgctcgatggcacaaggccaagaaagtgcagctcacccccggacaaactgaagtgaaaattgatctgcccctacctatagtggcatcgaacttaatgattgagttcgcagatttctacgaaaattatcaagcctcaactgagaccctgcagtgtcccagatgctccgcctctgtaccggctaaccctggggtttgcggtaactgtggtgagaacgtgtaccagtgccacaagtgtagatctattaactacgatgagaaagatccttttctgtgcaatgcctgtggattctgcaagtatgcgagattcgattttatgttgtatgcaaaaccctgttgtgctgtggaccccattgaaaatgaggaagaccgcaaaaaggcagtgtctaacatcaacacacttcttgacaaggccgatagagtataccaccagctcatgggtcatcggcctcagttggagaacctgctgtgcaaggtgaatgaagcagcgcctgaaaaaccccaagtggtaccacggtgcaaaggacacctggacaaagggctcggcctcgaccagaaaacggcgtcctag

SEQ ID NO: 55693 - DNA, 2673 bp, Artificial Sequence
  Description of Artificial Sequence: Synthetic coding sequence
atgctcgaagacatgactaccggaacagagagcgaaacaaaggccttcatggctgtgtgcatcgaaaccgccaagcgctataacctagatgattataggaccccggtgttcatctttgagaggctctgttccataatttatccagaagagaacgaggtgaccgagttttttgtgacgctggagaaggaccctcagcaggaggattttttgcaagggcgtatgccgggaaacccttatagttctaatgaacccggaattggacctttgatgagagacataaagaacaagatttgccaggactgcgaccttgtcgccctgctggaagacgacagcggaatggagctgctggttaataataagattatctctctcgacttgcccgtggctgaggtttataagaaggtgtggtgcacaacaaatgagggggagcccatgcggatcgtctatagaatgcggggacttctcggcgacgcaactgaggaattcattgaatcactggatagcactaccgatgaggaagaggacgaagaggaggtgtataaaatggctggagtgatggctcagtgtggcggtctagagtgtatgctcaataggctggcaggcatccgggactttaagcaaggcagacatctgctgacagtactgttaaaattattttcatactgcgttaaggtcaaggtgaacagacagcagctagtgaagctcgaaatgaatacccttaacgtaatgcttgggacccttaatctcgctctggtggccgaacaggagagcaaggacagcggcggtgccgcagtcgctgagcaggtactgtccattatggagataatcctagatgagagtaatgctgaaccactatcagaagataagggaaacctgctcctcacaggggataaagatcaattagtcatgcttctggaccagatcaactctacattcgttcgatctaatccctctgttttacagggtctgctgagaattattccgtacctatccttcggagaagtggaaaagatgcagattctggtcgagaggttcaagccctattgtaattttgataagtatgatgaagatcatagcggcgatgacaaagtatttctggattgtttttgcaagattgcagctgggattaagaataattcaaacggacaccagctcaaggacctcattttgcagaagggtattactcaaaatgcgctcgactatatgaaaaaacatattccctctgcgaagaacctggacgccgacatatggaagaagttcttgtctaggcccgcactgccttttatcctaagattacttagggggctagccatccaacatccaggaacccaggtgctaattggaacagattcgatccctaatctgcacaagttggaacaggtttctagcgatgagggaatcgggacgctggccgaaaacctcctagaagcactgcgggagcatccagacgtgaacaagaagatcgatgctgcaaggagggagactagagccgaaaaaaaacgaatggccatggcaatgagacagaaggccttgggtaccctgggaatgactacaaacgaaaaaggtcaggtcgttacaaagactgccttgctgaaacaaatggaggagctcatcgaagaacccggtctgacatgctgtatttgccgtgagggatacaaatttcaacctactaaagttctggggatctatacttttaccaagcgggtggccctggaggagatggagaacaaacccaggaagcagcagggatactctaccgtgtcgcattttaacatagtgcactacgattgtcatctggcagcagtaagactagcaaggggtcgcgaggagtgggaaagcgctgctctccagaacgccaataccaagtgtaacgggctgcttccagtttggggcccacacgtgccagagtcagcctttgctacttgtctggccaggcacaacacatatctccaggagtgtaccgggcagagagaacccacctatcagctcaatatccacgacattaagttattgtttctgcgttttgcgatggagcagtctttctccgcagacacaggtgggggaggcagggaaagcaatattcacttaataccctacattatacacacagtcctgtatgttctgaatactaccagggccacatcgcgggaggagaagaacctccagggatttctggaacaaccaaaagaaaagtgggtcgagtccgcgttcgaggtggacggaccttattatttcactgtgcttgcactgcacattttgccccctgaacagtggagggctaccagagtggagatactgagaaggctgctggtgacaagccaggcaagggcggtggcacccggtggcgctacaaggctgactgacaaggccgtgaaggattacagtgcgtacagaagcagccttctgttttgggccctggtggatctgatctataacatgtttaaaaaggtacccactagtaacactgaaggaggatggagctgcagccttgccgagtacataagacacaacgatatgcccatatacgaggccgctgacaaagctctgaaaacatttcaggaagaatttatgccagtggaaacattctccgaatttctggatgtggctgggctgctgtcggagataactgaccctgaatcctttctcaaggaccttctcaattcagtgccttag

SEQ ID NO: 55694 - DNA, 777 bp, Artificial Sequence
  Description of Artificial Sequence: Synthetic coding sequence
atgggtcccggaaagaagggcagatgtcgggaggagggcccaggtagggggcgaagagcatggatcataaggggctccggctcctctaggcaggggtgggtcggatctgtggaatcatcgaaaagatccgccaatgtgaccaggcaacgtcagatcgagcagattctgcccgcacttgctgctgggtcctgttttcaccctgcattcatcttgagctgtcgatttagtagccgcactcgtgctacctccagagaagaaaagaatctgcagggatttttagagcagcctaaagagaaatgggtggagtccgcctttgaggtagacggaccctactactttactgtcctcgcactccatattctccctcctgaacaatggagagctacccgggttgagattctgcggaggctcctggttacatcacaggctcgggctgttgcccctggaggggctacccgtcttaccgataaggcagttaaagactattcagcatacaggagctctctgctgttttgggccctggtggacttaatttacaatatgtttaagaaggtcccgacctcaaatacggaggggggttggtcctgctccttggccgaatatatcagacacaacgacatgccaatttacgaagccgctgacaaggctcttaagacatttcaagaggagtttatgcccgttgaaaccttctcggagtttctggatgttgccggtttattgtcagaaataaccgacccagaatcttttctgaaggacctattgaacagtgttccttag

SEQ ID NO: 55695 - DNA, 15480 bp, Artificial Sequence
  Description of Artificial Sequence: Synthetic coding sequence
atggccacatctggcggtgaggaggctgccgctgctgcaccggctcccggaacaccagccactggggctgatacaacgcctggttgggaagtggccgttcggccactgcttagcgcgtcatatagcgccttcgaaatgaaagaattacctcagttggtggctagcgtgattgagagcgagtcagagatcttgcaccacgagaaacagtatgagcccttttactcaagtttcgtggcgttgtcgactcattacattacaaccgtgtgctccctcattcccagaaatcagctgcagtctgtggcggcagcatgcaaggtgctgatcgagttctctctgttgcggttggaaaaccctgatgaggcttgcgccgtatctcagaagcacctcattttactgataaaaggtttgtgcaccgggtgctcacgtctggatagaaccgaaatcattacatttactgccatgatgaaatctgcgaaactcccccagacggtgaaaactctgagcgacgtagaggaccagaaggaattagccagccccgtttcccctgagctgcgccaaaaggaggtccaaatgaatttccttaatcagctaacctctgtattcaacccacggactgtggcaagccagccaatatccacgcaaacactcgtcgaaggcgagaatgatgaacagagtagcactgatcaggcctctgccataaaaactaagaatgtttttatagctcagaacgtggccagcctccaggaattggggggttctgagaaattgttacgggtctgcctcaacttgccttacttcctaagatacatcaatcgttttcaggacgccgtccttgctaacagttttttcattatgccagctacagtggccgacgccactgctgtcaggaatggtttccactcactggtcatcgacgttaccatggctctggacaccctgtcattacccgttctggagcctctaaacccatctcggctgcaggatgtaactgtgctctcattgagttgtctgtacgcaggcgtgagcgtggcaacatgtatggcaatcctacacgttggctcagctcagcaggtgcgcactggatcaacctcttcaaaggaggacgattacgaatcagatgctgcaaccattgtccagaaatgcctagaaatatacgacatgataggacaggctattagctcttctaggagagccggtggcgagcactatcagaattttcagctcctgggggcatggtgccttctcaactcattatttctcatcctcaatctcagcccaaccgcactagcagataagggcaaagaaaaggaccctctcgccgcactgcgtgtgagagatatcctcagtcggaccaaagaaggcgtgggcagcccgaaactgggtcctggcaaaggccaccagggctttggagtgctaagtgtgattctcgccaaccacgctattaagctgctgacatccctctttcaggacctgcaggttgaggcactccacaaaggctgggagacagacggcccacctgcagccctgtcaatcatggctcagagcacgtcaatacaacggatccagaggttaatcgattctgtgcctctgatgaatctgttactcacactgctgtccacctcttatcgtaaagcatgcgtgttgcagagacaaaggaagggctcgatgagttcagacgccagcgcttccaccgactctaacacctactacgaggacgacttctcttcaaccgaggaggatagcagtcaggacgacgactctgaacccatccttggacagtggttcgaggagacaattagcccatccaaggagaaggccgcaccccctccgcctccgcctccgcctcccttggaatcttctcctagagttaaaagtcccagcaagcaggccccaggcgagaagggcaacattctggctagccgtaaagatcctgaactgtttttgggacttgcctccaatatattgaactttatcacttcttctatgctgaactcccgtaataattttatcaggaattacctgtcagtttccctcagtgaacaccacatggccaccctggcctcaattattaaggaagtagataaggacggactgaaagggtccagcgacgaagaatttgccgctgccctttaccactttaaccattccctagtcacttccgaccttcagtcacctaatcttcaaaatacactgcttcaacagctgggagttgcacctttttctgaagggccatggccactgtatatacaccctcagagtcttagcgtgctgtcccgactgctcctcatatggcagcacaaagcaagtgctcaaggggatccagatgtacctgaatgtctcaaagtttgggatagattccttagcacgatgaagcagaatgcgctccaaggtgttgtgcctagtgaaacggaagacctcaatgtggaacacctccagatgcttctcctcatctttcacaatttcactgagaccggcaggagggcaatcctgtccctgtttgttcagatcatccaagagctgagcgtgaatatggacgcacagatgcgcttcgtacctctgattttggccaggctgctgttgatattcgattacctgttgcaccagtatagtaaggcccctgtctaccttttcgaacaggtgcagcacaacctgctgtccccgccattcggatgggctagcgggtcccaggactcaaactctagacgagcgacaacccccctgtaccatgggttcaaagaggtcgaggagaactggtcgaagcacttctcctctgacgctgttccccatccccgtttctactgtgtactcagtccagaagccagtgaggacgaccttaaccgacttgatagcgtggcctgtgatgtactcttctctaagttagtgaagtatgacgaactctatgcggcactgactgctctgctcgcagccggatctcaactcgacacagtgagaaggaaggagaacaagaacgtgactgccctcgaagcttgtgccctgcagtactacttcttaattctttggcgcatactcgggatccttcctccctctaaaacttacattaatcaactgagtatgaactcgcccgagatgagcgagtgtgacatcttgcacacattacgatggtctagccggcttcgcatttccagctacgtcaattggatcaaagatcatcttataaagcagggtatgaaagcagagcacgccagcagcttgttggagctggcaagcacaaccaaatgttccagcgtaaagtatgatgttgaaattgtggaggagtacttcgctcggcagatcagttctttttgtagcattgactgcaccacaatattacagttacacgagatccctagtctgcagtcaatctatactttggatgccgctatatccaaagtccaggtgtcgctggatgagcattttagcaaaatggcggcagagactgaccctcataaatcttcagaaataactaagaacttattaccagccacgctacagttgattgatacatatgccagcttcaccagggcatacctgctgcagaacttcaatgaggagggcaccactgagaaaccatctaaagaaaagttgcaggggttcgcagctgtcttggctattgggtccagtcgatgcaaagcaaacaccctgggcccaaccctggtacagaaccttcccagttccgtgcaaacagtatgcgagagttggaataacatcaacaccaacgaattccccaatatcgggtcttggaggaacgccttcgccaatgacactataccctctgagagttatatctctgccgtccaggcagcacatctggggaccctgtgctcccagtctctccctctcgctgcttcactgaaacacacgttgttgagcctggtcagattgacaggcgatctgatagtgtggtccgatgaaatgaacccccctcaggtgatccgcacactgcttcccctgctgttggaatccagcactgaaagtgtagccgagatctctagtaattcattggaaagaatactaggacctgccgagagcgatgagttcttagctagagtgtacgaaaaactgatcacaggatgttacaacatacttgcaaatcatgcagaccccaatagcggactagatgaatcaattttggaagaatgcctccaatatctggaaaaacagctggagtcctcgcaagcgcgaaaagctatggaggaattcttcagcgactccggggaactggtacagattatgatggctactgcgaacgaaaatctctccgctaagttttgcaaccgcgtcctcaaattttttacaaaattatttcagttgacagagaaaagtcccaatccatccctgttgcatctgtgcggtagcttggcacaactggcctgtgtggaacccgtcagactccaggcttggctgacacggatgacaacgagccccccaaaagactcggaccagctggacgtgattcaggagaatcgacaactcctgcagctgctgacgacttacatcgttagggagaacagccaggtaggcgaaggcgtgtgtgctgtgttgttgggcacccttactcccatggcgacagaaatgcttgccaatggcgacggtactggatttccagagctcatggtggtgatggccactttagctagtgccggtcagggggcaggacacctgcagctgcataacgccgctgtcgactggctttctaggtgtaaaaaatatctttcacagaagaacgtggttgagaagctgaatgcaaacgtgatgcatggcaaacacgtgatgatccttgagtgtacttgccatatcatgtcttatttggctgacgtgaccaatgccctttcccagagcaacggccagggtccctctcacctgtccgtggatggcgaagagagagctatcgaggtagactcagactgggtggaggaactggctgtagaagaggaagactcacaggcagaggactcggacgaggattccctttgtaataaactgtgtacgttcacaattacccagaaagagtttatgaaccagcattggtaccactgccatacttgcaaaatggtggatggagtgggtgtctgtactgtgtgtgcaaaagtatgccacaaagaccatgaaataagctatgcgaaatacggcagctttttctgcgattgtggtgccaaagaagacggctcttgtttagccctggtaaaacggactccttcaagcggcatgagctccaccatgaaggagtctgctttccagtccgagccaagaatctccgagtcactggtgcgccacgccagcaccagttctcctgcggataaggctaaagtgaccatctcggacggcaaggtggccgacgaggaaaaacctaaaaaatcatccctttgcaggaccgtagagggctgtagagaagagctgcagaatcaggctaatttctcattcgctcccctcgttttggacatgctgaactttctgatggatgccattcagaccaatttccagcaggcctccgctgttggcagctcctcaagagcccagcaggctcttagcgagttgcacaccgttgaaaaagccgtcgaaatgaccgatcaactcatggtgccaaccttgggctcccaggagggggcattcgaaaacgtccgcatgaactattctggagatcagggtcaaacgattcggcagctcatctctgctcacgtgctaagaagagttgctatgtgtgtcctttcatctcctcacgggagaagacagcacctggcagtttctcacgaaaaggggaaaattactgttttacagctgtccgcccttctcaaacaggcagactcctccaagagaaaacttaccctgacccgcttagcatctgccccagtgccctttaccgtcctcagcctcaccgggaacccgtgtaaagaggattacctggctgtttgtggcctgaaggactgtcatgtgctgacattttcaagttctgggagcgtgagtgatcatctggtgctgcacccacaactggctacaggcaactttataataaaagccgtctggcttccaggctcccagaccgagctagccattgtgacagcagattttgtgaagatatacgacctgtgcgtcgatgctctatctcctactttttactttcttctgccatctagtaagattcgcgacgtgacttttctgtttaatgaggagggaaagaacatcatcgttataatgagttctgcaggttatatctacactcagttgatggaggaagcttcctcagcccagcagggcccattttatgtcacgaatgttctcgaaattaaccacgaagatctgaaagatagtaacagccaggtggccggaggtggcgtgtcagtatattacagccacgtgctgcagatgctatttttcagctattgccaaggcaagtcattcgccgcaaccatctcccgcactactctggaggtcctccaactgtttcctataaatattaaatcgagcaatgggggttccaaaaccagtccggctctatgtcagtggtcagaggtgatgaaccatcctggcctagtgtgttgcgtgcagcagaccaccggagtgcccttagtggtaatggtcaaacccgatacctttcttattcaggagatcaaaacactgcccgctaaggctaaaattcaagacatggtggccatccgccacaccgcctgtaatgaacagcaacgaacaacaatgatcttgctctgcgaagacggcagtttgagaatctatatggcaaatgttgagaacacgtcttactggttgcagcccagtctacaacccagttctgtgatttcaatcatgaaacctgttagaaagcgcaaaaccgccactatcactactcggacatctagtcaggtgacatttccaatcgacttcttcgagcacaaccaacagctgacagatgtcgagttcggaggtaatgacttgctccaagtgtacaatgcccagcagattaaacaccggcttaacagtactggcatgtatgtggctaacactaaacctggcggttttacaatcgaaatcagcaataacaatagcaccatggtaatgacgggtatgcgcatccaaatagggacccaggcaatagaacgtgcaccgagctatattgaaatctttggacgcactatgcagctaaatctgtcccggtctcgatggttcgacttcccttttactcgggaggaagcattacaagctgataaaaagctgaacctgttcattggagctagtgtggatcccgcaggtgttactatgatcgatgccgtcaaaatatacggaaagactaaagagcagtttggttggccggatgagccccctgaggagttcccatccgctagtgtgagcaatatctgccctagcaacttaaaccagagcaacggcaccggcgactccgattccgccgctcccacgactaccagcggaacagtgctggagtccagtgagacagagtccctcacgaagctcgatcgccttgtggtaagttctctggaggccttagagtcctgttttgcagttggtccaataatcgaaaaggagcgcaacaagaacgctgcacaggagttggccaccttgctgctatccctcccggcacctgcatcagtgcagcaacagtcaaaatctcttctcgcttcgcttcatacgtctcggtcagcttaccacagccacaaggaccaagcccttctcagtaaggcggtccagtgcctgaatacgagtagcaaggaggggaaggatttagaccctgaggtgttccagagactagtgatcacagcccgaagtatagcgataatgcgacccaataacctggttcactttaccgagtccaaacttccacaaatggagacggagggcatggacgaaggcaaagagccacagaaacaactggagggtgattgttgctcattcattacccaactcgtgaaccatttctggaagctccacgcaagcaagccgaagaacgctttccttgctcctgcctgtcttcctgggcttacacacatcgaggctaccgtgaacgccctcgtggacattatccacggctactgcacttgcgagttggattgcattaatactgcctccaagatttatatgcagatgttgctgtgtcctgacccagctgtgtcctttagttgcaagcaggcattgatcagagtgctccggcctcgaaacaaacgtcgacacgtgactctgcctagttctccaaggtccaatacgccaatgggagataaagacgatgatgacgacgatgatgcagatgagaagatgcagagttctggaatccccaatgggggtcatattcgacaggagagccaggagcaaagcgaagtcgatcatggagatttcgagatggtctctgagagcatggtcttggaaaccgccgaaaatgtgaataacggtaatccatccccattagaggctctgctggctggagccgaaggcttccctccaatgctggatatcccccctgacgcagacgatgagaccatggtcgagctcgcgattgccctgagcctgcagcaggaccagcaagctcctgctagtgacgatgagggatctactgcagctactgacgggtccacgttacgtacatccccagccgatcacggcggatccgtggggtcagaatccggagggtcggccgttgattcagtggctggcgagcactccgtgtcaggcaggtctagtgcatatggagatgcgacagccgagggccaccccgcaggacctgggagcgtgtcctcgtccaccggagcaatcagcacaacaaccggccatcaggaaggagacggttccgaaggagagggagagggggagaccgaaggggatgtgcacacaagcaatcgtctgcacatggttcgcctgatgctgcttgagagattgcttcagacccttccacaattgcggaacgtgggaggggtacgcgcaatcccctacatgcaggtgatcttaatgctgacaaccgatctggacggcgaggatgaaaaggacaagggagcactagataatctcctctcccaactgattgcggagctgggcatggacaagaaggacgtcagtaaaaagaacgaaaggtcagcactaaacgaagtgcacctagtggttatgcgactgctgtcagtgttcatgtcacggaccaaaagtggttctaagagctctatttgtgagtcatccagtctgatttcttctgccaccgcggcagctttgctctcgtccggggcagtggactactgtctgcatgtcctcaagtcactgcttgaatactggaaatcccaacagaacgacgaggagccggtcgcaactagtcaattgctcaagccccatactaccagctcaccccctgatatgtcccccttctttttgcggcagtatgtcaagggacatgctgctgacgtgttcgaagcctacacacagctgctgaccgaaatggtgttgcgcctcccttaccaaattaaaaaaataaccgatacaaacagcaggatcccaccaccagtgttcgatcattcgtggttctactttctctctgagtacctgatgatacagcaaaccccatttgtgagacgccaggtacgcaagctattactgtttatttgtgggagcaaggagaaatatagacaactgcgggatctgcacaccctagactcccacgtgagaggcattaaaaagttgctggaggagcagggtattttcctgcgggcttctgtagttactgcatccagtggatctgcgcttcagtacgacactctcatctccctaatggaacatttaaaggcttgcgcagaaatcgccgctcagagaaccatcaattggcagaagttttgcataaaggacgatagtgtgctttacttcctgcttcaagtctcatttctggtggatgaaggtgtgagccctgtgctgttgcaactcttgtcatgcgcactttgcgggagcaaagtgctcgctgccctagccgcaagctctggaagtagctccgcaagtagtagtagcgcgccagtggcggcttcgtccggacaggctaccactcagtcaaaaagcagcaccaaaaaatctaaaaaagaggagaaggagaaggaaaaagacggggagacctcaggctcccaggaggaccagctttgcactgccctcgtcaaccagctcaataagtttgcagataaagagactctgatacaatttctgaggtgctttttacttgagtccaactcatcgtccgtacgttggcaggcacactgcctgacactgcacatataccgcaattcatccaaaagccagcaggaattgctgctggatctcatgtggtccatttggcccgaattgcccgcttatggcagaaaggcagcacagttcgttgacctactgggctacttcagcttaaaaacgccacagactgaaaaaaaactgaaagagtattctcagaaggccgtggagatccttaggacacagaatcacatccttactaatcatccaaactcaaatatttacaacacattgtcagggctcgtagaattcgatggctactaccttgagagtgacccatgcctagtctgcaataatcccgaagtccccttttgctatataaagttatcttctataaaagtggacacgaggtatacgacgacccaacaggtcgtcaagcttatcggatcacatactatttctaaggttaccgtgaagataggagacctcaagcgtactaaaatggtcagaaccatcaatctgtattacaataaccggaccgtgcaggccatcgtggagttaaagaacaaacctgccagatggcacaaggctaaaaaggttcagctaacaccgggacaaacagaagttaagatcgacctgccactcccgattgtcgctagtaacctgatgatagagtttgctgatttctatgaaaattaccaggcctccacagaaaccctacagtgcccacgctgctccgccagcgttcccgctaaccccggagtctgcggcaattgcggggagaacgtgtaccagtgtcataagtgtaggtccattaactacgacgaaaaggaccctttcctatgtaatgcctgcggcttttgcaaatacgcacgcttcgatttcatgctctatgccaagccctgctgcgctgtggaccctatcgagaacgaggaggatcgcaaaaaggcggtctcaaatatcaataccctgctggacaaagctgatcgagtgtatcatcagctcatgggacatagaccccaactcgagaacttactttgcaaggtgaacgaggcggcacccgaaaagccgcaagatgactctgggactgccggaggcatttcctctacatccgctagtgtaaacagatatatccttcagctggcacaggagtactgtggggattgcaagaatagttttgatgagttgtccaagattatccaaaaagtgtttgccagccgaaaagagctgctggagtatgaccttcagcagcgagaagcggctactaagtcctcccggacctcagtgcagccaacgtttaccgcctcccagtatcgtgccctctcggtgttggggtgcggccatacgtcctccactaagtgttacggctgtgccagcgcggtgactgagcactgtataaccctgttgcgggctttggctaccaatcccgcactcagacatatcctcgtgagccaaggcttaattagagagctgtttgactacaaccttcgcagaggcgcagctgctatgcgagaagaagtacggcaactcatgtgtcttctgacacgtgacaaccccgaggctacccaacaaatgaacgacctcattatcggcaaggtctccactgcactgaagggccactgggctaatccagatctagccagctccctccagtatgaaatgctgttactgaccgacagcattagtaaggaagactcgtgttgggaattaaggctccggtgtgcccttagcttgttcctgatggccgtgaatatcaagacacccgtggttgtggaaaacattacactcatgtgtctccggattctccaaaagctgatcaagcccccagctcctacctctaagaaaaataaggatgttcctgtggaggcccttaccacggtgaagccttactgtaatgagattcacgcacaggcccagctatggcttaagcgggatcccaaagccagttatgatgcctggaagaagtgcctgccaataaggggaattgacggaaatggcaaggctccatcaaagtcggagttaaggcacctttacctcacagaaaaatacgtctggagatggaaacagttcctctcccggcgaggcaaacggacaagtcccttagatctaaagctgggccacaataattggcttaggcaggtgctctttacgccagcgacacaagccgcaaggcaggccgcttgcaccatcgtggaggctcttgccaccatcccgtccaggaagcaacaggtgttagatctcttgacttcgtacctagacgaactttcaatcgcaggcgaatgtgcagctgagtaccttgccctgtaccagaagctgataactagcgctcattggaaggtgtacttagctgcaaggggcgttctgccatacgttggaaatctaattaccaaggagatcgctaggctgctagccctggaggaggccaccctgagcaccgacctgcagcagggctatgccttaaaaagtctcaccggccttctctcctcgttcgtggaagttgaaagtataaaacgccacttcaagagtcgcctcgtgggcacggtgctgaacgggtacctttgcctgagaaagctggttgtccagagaactaagctgatcgacgaaacccaggacatgttgttggaaatgcttgaggacatgaccaccggcaccgagagtgagaccaaggcctttatggccgtgtgcatagagactgccaagagatacaatcttgatgattaccgcacgccagtctttatttttgagcggctctgttccattatatatcctgaagaaaacgaggttacagagttttttgtgaccctggagaaggatcctcagcaggaggattttttgcagggtagaatgcccggaaatccatactcctctaatgaaccaggcatcgggcctctcatgcgcgacattaagaacaagatttgccaagactgcgaccttgtcgccctgctggaggacgactcaggaatggagctccttgtcaataataagatcatctctctcgatctcccggtggccgaggtctacaagaaggtatggtgcacgactaatgaaggagagcctatgcgcatagtctaccggatgcggggtctgctaggcgacgctactgaggagttcattgaaagccttgactccacaactgacgaagaggaggacgaggaggaagtatataagatggcgggagtcatggctcagtgtgggggactagagtgcatgctaaaccggctagcaggaataagagacttcaagcagggacgacacttgctcacagtcctgctgaaactcttctcttattgcgtgaaggttaaggtgaaccgccagcagttggtgaagctcgagatgaacacgttaaacgtaatgctcggaacccttaacttagctctcgtggcagagcaggagtcaaaggatagtggcggtgccgcagtcgctgagcaggtactgagtattatggagattattcttgacgagtcaaatgcggaaccactgtccgaggacaaaggaaacctacttcttacgggcgacaaagatcagctggttatgctgctcgaccagatcaatagcacctttgtccgctccaatcccagcgtactacaggggctgctgcggatcattccctaccttagcttcggagaagtggaaaagatgcaaatcttagtcgagaggttcaaaccttattgtaacttcgataaatacgacgaagatcactcaggtgacgacaaagtgtttctggactgcttttgcaaaatagccgctggcattaagaataattctaacggtcaccaactcaaagacctgatcctgcagaagggtattacccagaatgcactggactatatgaaaaagcatattccctctgccaaaaacctggatgctgatatctggaaaaagttcctcagccggcctgcgttaccctttatcctgcgtctcctgagagggctggccatccagcaccctggcacccaggtcttaattgggacggacagcatccccaacctccataagttggagcaggtgagcagcgatgagggcatcggtacactggctgaaaacctgttggaggccctgagggagcaccctgacgtcaataaaaaaatcgatgctgcccgacgcgagactagagccgagaagaaaaggatggcaatggcaatgcgacaaaaagccctggggacactgggaatgactacaaatgaaaaaggccaggttgtcacaaagactgctctcttgaagcagatggaggaattgatcgaggagccaggtctgacgtgctgtatctgccgggagggctacaaattccagccaaccaaagtgctgggaatttatactttcaccaagagggtggcactcgaggagatggagaacaagcctaggaagcaacaggggtacagcaccgtgtcgcacttcaatatagtgcactatgattgccacttagctgcagtgcggctcgcacgagggagagaagaatgggaaagtgccgcacttcagaatgccaatacgaagtgcaatgggctccttccggtttggggacctcacgtcccggagtccgcattcgcaacctgcttggcccgacataatacttacttgcaggaatgcacaggacagcgggaacccacataccagttgaatattcacgacattaagctcctattcctgcgtttcgctatggaacagagtttctccgcggacaccggaggcggaggacgtgagagcaatattcacctaatcccctatatcatacacaccgttctctacgtgctaaacactacacgggcaacttccagagaagagaagaatctgcagggattcctcgagcaacccaaagagaaatgggtggagtctgcattcgaggtcgatgggccatactattttacagtgcttgcactgcacatactcccacccgagcaatggcgcgctacgcgcgtcgaaattctgcgaaggcttctcgtgacatcacaggccagggccgtggcaccaggcggagctactcggctaaccgataaggctgtgaaagactacagtgcataccgatcctctcttttgttctgggctcttgtagatctgatttataacatgttcaagaaggtgccaacgtcaaacaccgagggcggttggagctgtagccttgccgagtatataagacacaatgatatgcccatctatgaagcggcagacaaggcccttaaaaccttccaggaagagtttatgccagtcgaaacgttctccgagtttctggacgtagctgggctactcagtgaaattacggatcccgagagcttcctcaaggatctcctgaattctgtgccctaa

SEQ ID NO: 55696 - DNA, 15552 bp, Artificial Sequence
  Description of Artificial Sequence: Synthetic coding sequence
atggccacatccggcggagaagaggctgcggctgcagcaccagccccaggaacgccagctactggggctgacacaactccgggatgggaagtggctgtgcgcccattactgagtgcatcctatagcgcgttcgagatgaaagaactgcctcaactggtggcttcagtgatcgagtccgagtccgagattcttcatcacgaaaaacagtacgagccgttttatagtagtttcgtggcattgtcaactcactacattacgacagtgtgcagtctaatcccaagaaaccaactccagtcagtcgcagcggcttgcaaggtgctaatcgagttctcattgcttcgcctggagaacccagacgaggcatgcgcagtatcccagaaacacctgatactgctgattaaagggctttgtactggctgcagtcgcctggacagaacggaaattatcaccttcaccgctatgatgaaaagcgccaaactccctcaaacagtcaagactcttagcgacgttgaagaccagaaagagctggcctccccagtgtcccccgaactcagacagaaggaggtgcagatgaatttcttaaaccagcttacttccgtcttcaatcctagaaccgtggcctcccaacctatttctacccaaaccctcgtggaaggcgagaatgacgaacagagttccacagatcaggcctcggctatcaaaacaaagaacgtttttatcgcacagaacgtggctagtctgcaggagctgggcggttccgagaagctcctccgggtgtgtctgaacctgccctactttctgaggtacataaacagatttcaagatgcagtacttgccaattccttctttatcatgccggcaaccgtagccgacgcgacagcggtccgaaacggatttcacagtctggtgattgatgtgaccatggctctggacaccttgagtctgcccgtgctcgaaccactcaacccctcacggctgcaagacgtgacagtgttgagccttagttgtctctatgctggtgttagcgtggcgacctgcatggccattctccatgtgggatccgcccagcaggttcgtactgggagcacaagcagcaaagaggacgattatgaaagcgacgctgctaccatcgtacaaaaatgcttggaaatttatgacatgattggccaagccatttcatcatcaagacgtgcaggcggtgagcattatcagaacttccaattgctgggtgcatggtgcttgttgaactccctcttcctgatcctgaacttatccccgaccgctctcgccgacaaaggcaaagaaaaggaccctcttgctgctctaagggtcagagatatcctgtcccgcaccaaggaaggggttggcagccccaaattggggcctggaaagggacatcagggtttcggggtgctgagtgtgatcctggctaaccatgctattaagttactgaccagtttgttccaggacctccaggtggaagctctgcataaggggtgggagacggatggcccacctgcagccctaagcatcatggctcagtctacatccattcagcggatccagcgactgatagatagtgttcccttgatgaacctgctgctgaccctcctgagcactagctatagaaaggcttgcgttctgcagaggcagcgcaagggctctatgagttcagatgcctccgcctccactgatagcaatacatactatgaggatgacttttcctctactgaggaggactccagccaagacgacgactctgagccgattctcggccagtggttcgaagagacaatctccccctctaaggagaaagctgcccctccaccccctccgcctccgccacctttggagtcttctccccgagtgaagagtccttctaagcaggcgcctggcgaaaaggggaacatcctcgccagcagaaaagaccccgagctctttctcggactggcttcaaacattctgaactttatcacttcatcgatgctaaattctaggaataacttcattcgaaactacctgtccgtctccctcagcgagcatcacatggctacactcgcctcgattattaaggaagtcgacaaagatggcctaaaaggctcttctgatgaggagtttgccgcagccttgtaccatttcaaccatagcctggttacatccgatctgcaatcccctaacctgcaaaatacactgctccagcagctaggggttgctccattttccgaaggcccatggccgctgtacatacacccccaatctctgagcgtgttgtcccggctccttctcatctggcagcacaaagcttccgctcagggtgatcctgacgtgcctgagtgtctaaaggtgtgggatcgcttcctaagtacaatgaaacaaaacgctcttcagggggtagtacccagtgagaccgaagacctgaacgtggagcacctgcagatgctactgttgatcttccacaattttaccgagactggcaggagagccatcctgtcattgttcgtgcagatcatacaagagctgtcagtcaatatggacgcccagatgagatttgtgcccttgatccttgctaggctactcctgatctttgattacctgcttcatcagtatagtaaagctcccgtgtatctgtttgagcaagtgcaacataacctgctgtcgccgcctttcgggtgggcatccggctcccaagactcaaatagccgaagggccaccacccctctatatcacggtttcaaggaggtggaggaaaattggagcaaacacttttcttcagatgccgtcccccatcctagattctattgtgtcctgtcccccgaggcctccgaggacgacctcaatcggcttgacagcgtggcctgcgacgtgttgtttagcaagctcgtgaaatatgacgaactctacgccgctctgacagcattgttggcggcaggttcccaattagacaccgtcaggcggaaagaaaataagaatgtgacagcactggaggcctgtgctttgcagtattactttttgattctctggcgaatcctggggatcttgcctcctagcaaaacatacataaatcaactttccatgaactcacctgagatgtctgagtgtgatatcctgcacaccctgaggtggtcgagccgattgcgtatcagttcctacgttaactggatcaaggatcacttgatcaagcagggtatgaaggctgagcatgcctcaagtctgttagaactggcctccacaaccaaatgtagtagcgtgaagtatgatgttgaaatagtcgaagagtattttgctcgacagatcagcagcttctgcagtattgattgcactactatcttacagcttcatgaaatcccgagtttgcagagcatttatacactggatgccgcaattagcaaggtgcaggtcagcctcgatgaacacttctccaaaatggctgctgaaaccgatccccataaatctagcgaaatcacgaagaatctactgcccgcaacattgcagctgatcgatacctatgctagctttactcgggcttacctgctgcagaactttaatgaagagggcaccaccgagaaaccctccaaggagaagctgcaagggttcgctgcggtgctcgcaattggttcttcccgatgtaaggccaacacactgggcccaactctggtgcagaacctgccttcttctgtccagacagtgtgtgaatcctggaacaatattaacacaaacgaattccccaacataggcagctggcgaaatgcttttgcaaacgataccattccctctgaatcttacatcagcgctgttcaggcagcccatttggggacgctttgctcccaaagccttcctcttgccgctagcttgaagcatacactgttgagcctggtgagactcaccggggatttgatcgtgtggtctgacgagatgaacccgccacaggtaatccggaccctcctgcccttactccttgagagctctaccgaatctgtggccgagatctcttctaactcgcttgagaggatcctcggacctgctgaaagtgatgagttcctagctagagtgtacgaaaagcttatcaccggctgctacaatattctggccaatcatgcagatcctaactctggcttggacgagagcatcctggaggagtgtctccagtatctggaaaagcagctggaaagtagccaggcaaggaaagccatggaggaattcttctccgacagcggggagttggtccagataatgatggcgacagctaacgagaacctgtccgcaaagttttgtaatagggttcttaagtttttcactaaactatttcagcttaccgagaagagtccgaatccatcacttctgcatctgtgcggtagcttagcacagctcgcctgcgtcgagcctgtaaggttgcaggcatggttaactaggatgactacctctccaccgaaggatagcgatcagcttgatgtgatacaagaaaataggcagttactacagttactgactacatacatcgtaagagaaaatagccaggtgggagagggcgtctgcgccgtactgctgggaaccctgacgccaatggcaaccgaaatgctcgctaacggagacggtaccggctttcctgaactgatggtggtcatggcgacattggcgtctgctggccagggtgccggtcaccttcagttgcacaacgccgctgtggattggctgtcaaggtgcaagaaatatctgagccagaagaatgtagtggagaaactcaacgccaatgtcatgcatggaaagcacgtgatgatcctggagtgcacctgccacatcatgagctatctggctgacgtaaccaacgcattatcgcagagtaacggtcaaggtccaagccacctcagcgtagacggcgaggaaagagccattgaggtggatagtgattgggttgaggaactggcagtggaagaagaagattcacaggccgaggattccgatgaggactccctgtgtaataagctgtgcacatttaccatcactcaaaaggagttcatgaaccagcactggtaccactgccacacatgcaaaatggtggacggcgtgggcgtctgcaccgtgtgcgcgaaggtctgtcacaaggatcatgagatatcttatgcaaaatacggcagttttttttgcgattgcggtgccaaagaagacggctcctgcttggctcttgtgaagcgtacccctagtagtggaatgtccagtacaatgaaggagagcgcctttcagtcagaaccacggattagcgaaagccttgtgcgtcatgcctccacaagctcccccgctgacaaggcgaaggtgactatcagtgatggaaaagtggccgatgaggagaagcctaagaaatcttcgctgtgtagaacagtggagggctgtagagaggagctccagaaccaggccaactttagttttgcgcctcttgtgctggatatgctcaacttcctgatggatgcaattcagactaactttcagcaggcctccgcagtcggctcatctagcagagcccagcaggctctatccgaacttcatacggtggagaaggctgttgaaatgactgatcagctcatggtgcctactttaggatcacaggagggcgcttttgagaacgtgcgaatgaactattccggagaccagggccagaccatcaggcagctcatcagcgcccatgtgctaaggagggttgctatgtgcgttctatctagcccacatggtaggcggcagcatctcgcagtgtcccatgaaaaaggcaagattaccgttctccaactgagcgctctgctaaagcaagccgactcttccaagcggaagcttacattaacacggttggcgtccgcgccagtcccttttactgtcctgtccttgaccggaaatccctgtaaggaggactatttggctgtgtgtggcctcaaagactgtcacgtgttgactttttcttccagcggttctgtatcagatcatcttgtgctgcacccccaactcgctaccgggaactttattatcaaggctgtctggctgcccggaagccagacagaactggcaattgtgacagctgacttcgtgaagatttacgacctatgtgtggatgcgttgtccccaacgttttattttctcctgccgtctagcaaaatcagagacgtgacatttctgttcaatgaggaggggaagaacattattgtcatcatgtcctcagccggatacatctacactcagctaatggaggaagcctcaagtgcccagcagggacccttttacgttacaaatgtattggaaataaatcacgaggacctgaaagacagtaattcgcaagtcgcaggtggcggtgtctcagtgtattactcccacgtcctacagatgttattcttctcctactgtcagggtaaatcttttgcggctaccatcagccggacgactttggaagttttgcaactatttccaataaatataaagtcatccaacgggggaagcaagactagtcctgccctttgccagtggtccgaagtgatgaaccaccctggtttagtatgttgcgtccagcagaccaccggcgttccactcgtggtgatggtgaagccggatactttcttaatccaggagatcaaaactctacccgcaaaggcaaagatccaggatatggtcgccattcggcataccgcatgtaatgaacagcagcggacaaccatgatcctactctgcgaggacggcagcctcaggatatatatggccaacgttgaaaacacatcatattggctgcaacctagtttacaaccatcttcggtgatctcaattatgaagcctgtgcgaaagagaaaaaccgcgacaattaccacccggacgagctctcaggtgacattcccaatcgactttttcgagcacaatcagcagctgactgatgtggagttcggaggcaacgacctactccaagtctacaacgctcagcagatcaagcatcggcttaattcaaccggaatgtacgtcgctaataccaaacccggaggctttacaatagaaatcagcaacaataattccaccatggtgatgactggcatgcgaatccagatcggcacccaggctattgaacgcgctccctcgtacatcgagattttcggaagaaccatgcaactcaacctttcccggtcgagatggtttgactttccattcactagggaggaggccctccaggccgataaaaagctcaacctgttcatcggagcgtcggtggatccagctggagtgacaatgatagatgcagtgaaaatctatggaaagacgaaggaacagttcgggtggccggatgaaccccctgaggaatttccttccgcatcggtatcaaacatctgtcctagcaatttaaatcagtcgaatggtactggcgacagcgacagcgccgcacctacaacaactagcggaacggtgttggaaaggctggttgtgtcttctctggaggccctggagtcttgctttgccgtcgggcctatcatcgagaaggaacgtaataagaacgcagctcaagagctggcaacgctcctcctgagcctgcctgcccctgcttcagtgcagcagcaatcaaaatcactgctggcctccctccacacatctaggagtgcataccactcccataaggaccaggcgctgctgtcaaaggctgtgcagtgcttgaatacatcctcgaaggagggcaaggatctcgacccagaggtatttcagagacttgtcatcactgcacgttccatcgccattatgaggccgaataaccttgtccacttcacggaaagcaagctgccccagatggagactgaaggcatggatgaggggaaagagcctcagaaacaacttgaaggggattgctgttccttcatcacacaactagtgaaccatttctggaagctgcacgctagtaaaccaaagaacgcattcctggccccagcttgtttaccgggactaacccacatcgaggcgaccgtcaatgcccttgtggatatcatccacgggtactgtacttgtgaattagactgcataaacacagccagtaaaatttatatgcagatgctgctatgcccagatcccgctgtaagtttttcctgtaaacaggcgttgatacgggttttgaggcctagaaataaacgcaggcacgtaaccctgccgagctctccaaggagtaatacccccatgggagacaaggatgatgacgacgacgatgatgccgacgagaaaatgcagtcctctggcatcccaaatggaggccatattagacaggagagccaggagcaaagtgaggtggaccatggtgactttgagatggtctccgaaagcatggtcctcgagactgccgaaaatgtcaataacgggaacccttctccactagaggcgctattggccggagccgaaggatttccaccgatgctggacattcccccagatgccgatgatgaaaccatggtggagctggctatagccctgtctttgcagcaagatcagcaggggagtagctcaagcgctctcggccttcagagcctgggcctctcaggtcaggccccatcaagctcttcacttgatgcaggcacactgtccgataccacggcctcagctcccgcatcagacgacgaaggctccacagccgctaccgatggcagtacacttcggacttcccccgcagaccacggcggttccgttgggtccgaatcaggcggttccgcagtggatagcgttgccggagaacactcagtcagcggaagatcctctgcctacggcgacgctacggctgagggtcaccctgccggtcccggtagcgtctcatcttctacaggcgcaatctccacaacaaccggccatcaggaaggtgacgggagcgagggtgagggggagggcgagaccgagggggacgtacacacgtccaacaggctgcacatggtgagactgatgttgctggagaggctattgcagactctaccccagctgaggaacgtcggcggagttcgtgccattccttatatgcaagtcatcctaatgctaacgacagatttggatggggaggacgagaaggacaagggagcccttgataacttgttaagtcagctgattgcagagctgggcatggacaagaaggacgtctcaaaaaagaacgagaggagcgccctgaatgaagttcatctcgtggttatgaggctcttgagtgtgttcatgagtcgcacaaaaagcggatccaagtcctccatttgcgaaagtagttccctgataagctccgcgacagctgcagccctgctgtccagcggggctgttgactactgtctgcacgtcctaaaatccctcctggaatattggaagagccaacagaatgatgaggagccagtagccacctcgcagctgttaaaaccacacactactagttctcctccagacatgagtccattctttctacgacagtacgtcaaggggcacgcagctgatgtcttcgaggcatatacccagctactcaccgaaatggtgctgagacttccttaccagatcaagaaaataacagacacaaactcacgtatcccaccccctgttttcgatcacagctggttttatttcttaagtgaataccttatgatacagcagactccattcgtgaggcggcaagtacgcaagctgctgctttttatttgcgggagcaaggagaaataccgtcagctcagagatttacatacgttggatagccatgtccgcggaattaaaaagcttctggaagagcaggggatcttcctgcgggcatctgtggtgacagcctcatccgggagcgcattacagtacgatacacttatctctcttatggaacacctaaaggcatgtgctgaaatcgctgcccagcggacaatcaactggcagaagttctgtatcaaggacgattctgtcctctatttcctcctgcaggtatcattcttggtcgacgagggagtgtcccctgttctgcttcaattactgtcctgcgcactatgtgggtcaaaggtgcttgccgcactggcagcgtctagtggtagcagcagcgcttcctctagctctgctccggtggccgcttcctctgggcaggccacaacccagtccaagagcagcaccaagaagagcaagaaggaggaaaaggaaaaggagaaagatggcgagaccagcggttcccaagaggaccaactgtgcacggcactggtcaaccagttgaacaagttcgctgacaaagaaacactgattcagttcttgcgctgctttctgctcgaaagcaactcatccagcgtaaggtggcaggcccactgccttacactccacatctatcgtaattcctctaagtcccaacaggagttactcctcgatctaatgtggtctatttggcccgaattacccgcttacggcaggaaagcagctcagttcgttgacctgctggggtacttctcacttaaaacgccacagaccgagaaaaaactgaaggagtattcacagaaggccgtggagatcctgcgcacccaaaatcacattctgaccaaccatcccaacagtaacatttacaacaccctttccggccttgtggagttcgacgggtactacctggagtctgatccatgcctggtatgtaataacccggaggttccattttgttacatcaaactgagctctattaaggtcgacacacgatacacaacaacccagcaagttgtgaaactcatcggttcccatactatcagtaaggtgacagtaaaaattggtgacctgaaacgcacaaaaatggtgagaaccattaacctgtactataacaacagaactgtccaggctatcgtggagctgaaaaataaaccagccaggtggcacaaggctaagaaggtccagctcaccccaggccagactgaggttaaaatcgacttgcctctgccgatcgtggcatccaatctgatgatcgagttcgctgacttttatgagaactaccaagcatccacagagaccctccagtgcccccgttgcagtgctagtgtccccgcaaatcccggagtttgcggaaactgtggagaaaacgtataccagtgccataagtgccggtctataaactatgacgaaaaggacccgtttctctgcaacgcttgtggcttttgtaaatatgctaggttcgatttcatgctgtacgccaaaccttgttgcgctgtcgatcccatagagaatgaggaagatagaaagaaagctgtgtcaaacatcaacaccttgcttgacaaggcggacagagtctaccaccagctgatgggacacaggccccagttggaaaacctgttgtgcaaagtgaatgaggctgccccagagaagcctcaggatgattcgggcacagctggcggtatctctagtacaagcgccagtgtcaaccggtacatcctgcagttagcccaagaatactgcggcgattgtaagaatagctttgatgaactgtccaagataatccagaaagtctttgcttcaagaaaagagctgctcgaatatgatctacaacaacgtgaagcagcaactaaatcctcaaggacttccgtgcagccaacatttacagcaagccagtatcgggctctgagcgtgcttgggtgcggacatacatcttcgacgaagtgctacgggtgcgcctcggccgtgaccgaacattgcataactctgttgagagccctagcgaccaaccccgcactgagacatattctcgtatcccagggactcattagggagttgtttgactataatttgcggaggggtgctgctgccatgcgagaggaagtcaggcagctgatgtgtctgctgacaagggacaatccagaagccacgcaacagatgaatgaccttattattggaaaagtgtcaaccgcgttgaaggggcactgggccaaccctgatttagcttcttccctccagtatgagatgctcttgttgacggattctatctctaaggaagacagctgctgggaactgaggctacgatgcgcattgtccctgttcctcatggctgtcaacatcaaaactccagttgttgtcgaaaatatcaccctgatgtgtcttagaattttacaaaaacttatcaagcctcctgcccctacttctaagaagaacaaggatgttccagtcgaagctctgacaacggtcaaaccttattgcaacgagatccatgctcaagctcaactgtggctgaagcgggatccaaaggcctcatatgatgcctggaaaaaatgtttgcctatccgcggaattgacggtaacgggaaagccccatccaagagcgagctgagacatctgtacctgacggagaaatacgtttggcgatggaaacagtttctgtcaaggcgtggcaaacgtacctcaccgctcgacttgaaattgggacacaataattggttgcgtcaggtgttgtttaccccagcgacccaagcagcccgtcaggccgcatgcactatcgtcgaggccctggcgactatcccctcacgcaagcagcaagtgctggatctcctaacttcatatctcgacgagctaagcatcgcgggagagtgtgcggcagaataccttgcactctaccagaagctgatcacgtctgcccactggaaagtgtacttggccgctcgaggtgtgctgccgtacgtgggaaatctgatcacaaaggaaattgccaggctgctggctcttgaagaggccaccctctcaaccgatttacaacagggatatgccctgaaatccctgacaggactgttatcctccttcgtggaggttgagtctatcaaaaggcactttaagtcccggctggtgggcaccgtactcaacgggtacttgtgccttcgaaagttagtagtgcagagaaccaaactgattgatgaaacacaggacatgcttcttgaaatgcttgaagacatgacgactggaaccgagtccgagacgaaggcatttatggcggtgtgcatcgagaccgccaaacggtataaccttgacgattaccgaacgccagtgtttatcttcgagagactatgttcaattatttatcctgaagagaacgaggtcaccgagtttttcgtgacccttgagaaggatcctcagcaagaagatttcctacagggaaggatgccgggtaatccttactcttcaaacgaaccaggaatcggacccctgatgagggacatcaagaacaaaatttgccaagattgtgatctggttgccctgctcgaagatgatagcggcatggagctccttgtaaataacaaaataatcagcctggatcttcccgtggccgaagtgtacaaaaaagtctggtgcaccaccaacgaaggagagccaatgcggatcgtgtaccggatgaggggtcttctcggtgatgctactgaggagttcatcgagagcctggattccacaaccgatgaagaggaggacgaggaggaagtgtacaagatggcaggcgtgatggctcaatgtggcggtctcgagtgcatgctcaacagactcgctggtatcagggatttcaaacagggcagacacctgctgaccgtgctgctgaagctcttcagttactgtgtgaaggtcaaggtcaacagacagcaactggtcaagctggagatgaatactctcaacgtgatgttgggcacgttaaatctagccttagtggcagagcaggaatcaaaagactccggcggtgccgcagtggcggaacaggttctgagtattatggagattatcttggacgaatccaatgccgaacctttatccgaggacaagggcaaccttcttttgaccggcgacaaagaccagctggtcatgcttttggatcaaatcaactctactttcgtccggtcaaacccttcggtattgcagggattgctgcgaatcattccgtatctgtcttttggtgaagtggaaaagatgcagattctggttgagagattcaagccatactgcaattttgataaatatgacgaagaccactcaggtgacgataaggtgttcctagattgcttctgtaaaatcgccgcagggatcaagaacaacagcaatggccatcagctcaaagaccttattctacaaaaaggaatcacccagaatgctctcgattatatgaagaaacacatcccgagcgcgaagaatttggacgcagatatctggaaaaaatttctgagccgtcctgctttacctttcattctccgtctattaaggggtctggccatacagcaccctggtacacaggtgttaattgggactgatagcattccaaacctgcacaaactagaacaggtgagctccgacgaagggataggtactttagcggagaaccttctggaggccctgagagaacacccggatgtcaataagaaaattgatgccgcacggagagagaccagggcagagaagaaacgtatggcaatggccatgaggcaaaaggccctggggacccttgggatgacgaccaacgaaaagggccaggtcgtaaccaaaaccgcactcctgaagcaaatggaggaactgattgaggaacctggcctgacatgttgtatttgcagagaagggtacaaatttcagcctacaaaggtgttgggaatttatactttcaccaaaagggtggccctcgaggaaatggagaacaagccgaggaagcagcagggctatagtaccgtatcacacttcaatattgtacactacgattgtcacctggcagccgttcgcttagctcgtggcagggaggagtgggagtccgcagcgcttcagaatgctaatactaaatgtaacggtctgctgcctgtttggggacctcatgtaccggagtcagcgtttgcaacctgtcttgccagacataacacatatctgcaagaatgtacgggacagcgggaaccaacatatcagcttaatattcacgacatcaaattgctctttctgcgcttcgccatggagcagagcttctcagccgacacgggagggggtggaagggagagcaacatccaccttatcccctatattatccataccgtcctctacgtcctgaatacaacacgggctacaagcagggaagagaaaaacctgcaggggtttttggaacagcccaaagagaagtgggttgaatcggcatttgaagtggatggaccttactacttcacagtactggccctgcatatcctacctccagagcaatggagagccacaagggtcgaaattttgagaaggctccttgtaacctctcaggcgcgtgccgtggctcccggtggtgccactcgactcacagacaaggcggtcaaggattacagtgcctaccgctctagtctcttgttttgggctttagtggatcttatctataatatgtttaagaaggtgcccaccagcaatacagaaggtggttggagctgctccctagccgagtacatacggcataacgacatgcccatttatgaggctgccgacaaggcacttaaaaccttccaggaagagttcatgcctgtagagactttctctgagtttctcgatgtggccggacttctcagcgaaatcacagatccagagagcttcttgaaggatctgttgaactccgtgccatat

SEQ ID NO: 55697 - DNA, 15615 bp, Artificial Sequence
  Description of Artificial Sequence: Synthetic coding sequence
atggctacctcggggggagaggaggcagccgctgctgccccagcccctggtacacccgcaaccggagcagacacgacaccaggctgggaagtggccgtgagacctctcttatctgctagttactccgcatttgagatgaaagagctgccccagttggtggcctccgtgatcgaatcggaatcggaaatacttcaccatgaaaaacagtacgaaccgttttattccagtttcgtcgcgctgagtacgcactacatcaccaccgtgtgcagcctgatccccagaaaccagctgcagagcgtggcagctgcctgcaaagttttgatcgaattcagcctgctgaggctggaaaacccagatgaggcctgcgccgtgtcccagaaacatttaatcctgttgattaaggggttgtgcacagggtgttctcgcctggacagaaccgagattatcaccttcacggcaatgatgaaaagcgcaaaactccctcagacagttaagaccctttccgacgttgaggaccagaaagagttggcctcaccggtaagccccgaacttcgtcagaaggaggtgcaaatgaattttctcaaccaattgactagcgtgttcaaccccagaaccgtagccagccagccaatcagcactcagaccctggttgagggcgaaaatgatgaacaaagtagcacagatcaggcatctgcaatcaaaaccaagaatgtcttcattgcacagaacgtggcttctctccaggagctggggggaagtgaaaagctgctcagagtgtgtctgaatctcccgtattttctgagatatattaatagattccaggacgcagtcctggcaaacagcttctttatcatgccagctacggtagctgacgctactgctgtgcgtaacggatttcactcactggtcattgacgtaacaatggctttggacacactctctcttccagttctggagcccctaaatccaagtcggctgcaggacgttactgtcctgagcctgtcatgcctatatgccggagtatccgtggctacttgtatggccatcctgcatgttgggtctgctcaacaggtgcgtacaggatctactagcagcaaagaggatgactatgagtccgacgctgcaaccatcgttcagaaatgtctagaaatatatgacatgattggacaagctatctcctcatccaggcgagccggtggtgagcactatcagaattttcagttgctaggcgcttggtgcctgttaaacagcctctttctgatcctaaatctctcacccactgcactcgcagataaggggaaggaaaaggacccactcgctgcacttagggtcagagacatattatcccgaacgaaagagggcgtgggctcgcctaagctgggcccaggtaagggtcatcagggcttcggtgtcctctcagtgatactcgccaaccatgcaattaagcttctgacctcccttttccaggacttacaggtcgaggccttacacaaggggtgggagactgatggtccacctgccgctttgtcaatcatggcccaatcgacctcgattcaacgcatacagaggctgatcgattctgtgcccttaatgaaccttctcctgacactcctgagtactagttaccggaaggcatgcgttttgcagcggcagaggaagggcagcatgtccagtgacgccagcgccagcacggattctaacacctattatgaggatgacttctcctcaaccgaagaagattcatcacaggatgacgactctgaaccaattctcggacagtggttcgaggagaccatttcaccaagtaaagagaaagctgcccctccacctccccctcctccacccccactggaatcaagcccacgagtgaagagtcccagcaagcaggctcccggtgagaaaggaaacattctcgcatccaggaaagacccagagttgtttctgggcctggcgtccaacattctgaatttcatcacctcttccatgttgaacagccgaaataacttcattaggaattatctcagcgtttctctgtccgaacatcatatggcaacactggccagcatcatcaaggaggtggataaggatggattgaaaggtagctcagacgaagagtttgctgccgcactgtaccattttaaccacagcctcgtaacatcagatcttcagtccccgaacctgcagaacactctcctgcagcagcttggggttgctcccttctctgaaggaccctggcctctctacatccaccctcagagcttatctgttttatcacgcctgctcctgatctggcagcataaggcctcagcccagggtgaccccgatgtgccggagtgtctgaaggtatgggataggtttctctcaaccatgaagcaaaacgcgctccagggagtggttccttccgagaccgaagatctgaatgtcgagcacctgcagatgttgctgttaatcttccataattttaccgagacaggaaggcgagccatcctcagccttttcgtacagataattcaagaattaagtgtaaatatggatgctcaaatgcgctttgtgcctttgatcctggctaggctcctcctaatctttgactacttgctgcaccagtactcaaaggctcccgtctacctctttgaacaggttcaacacaacctgttgagtcctcccttcggttgggcctccgggtcccaggacagcaactccaggcgggctacaacgcctctgtaccatggatttaaagaagttgaggagaattggagtaagcacttttcatctgatgcagttccgcaccccagattttactgcgtgctgtcccccgaggcatcagaggatgatctgaatcgactagattctgtggcctgcgatgttttattctccaagctggtgaagtacgatgagctgtacgcggctctgactgccctgctggcagccggatcgcaactggatactgtgcgcaggaaagagaataaaaatgtaaccgccttagaagcatgcgccctgcagtactactttctgatcctctggcgcattctaggcatcctgccgccatccaaaacgtacattaatcagctttccatgaattcacccgagatgagtgagtgcgatattttgcacacattgaggtggtctagcagactgcggatctcctcttacgttaattggattaaggatcatttgattaagcagggaatgaaagctgaacatgctagcagcttacttgagctggcatctaccacaaaatgcagtagcgtgaagtacgatgtagagatcgtggaagaatactttgcaagacagattagcagcttctgtagtattgattgtacaacaatcttacagctgcatgagattccctcattgcagagcatatatactctggacgcagctataagcaaagtccaagtgagcctggatgaacatttcagcaaaatggctgcagaaacagacccacacaaaagttccgaaatcaccaagaatctgctgcctgctacactacagctgatagacacttatgcctctttcacccgagcctatcttcttcagaactttaatgaggaggggaccacagaaaaacctagcaaagagaaacttcaggggttcgcggcagtcttggctattggctccagcaggtgtaaggcgaacaccctggggccaactctcgtgcagaacctcccgtcgagtgtccagaccgtgtgtgagtcttggaacaatataaatacaaatgaattccccaatatcggctcttggaggaacgcattcgctaacgacaccattccctccgaatcttatattagtgccgttcaggcggctcaccttggaaccctatgctcccagagccttcctttggctgcatccctgaaacacacactgcttagccttgtgcgcttgactggggatcttatcgtctggagtgatgaaatgaacccccctcaggtgatacggacattgcttccactgctgcttgagagctccaccgaatctgtcgctgagatctccagtaacagcctggagcggatcctgggacctgccgagtccgatgagttcctcgcccgagtctacgagaagttaattacgggctgttacaatatcttagccaaccatgccgaccccaatagcggattggacgagagcattttggaagaatgcctgcagtacctagagaaacagctggagagttctcaggcacgcaaagcaatggaagaattcttttccgactctggagaactggtacagataatgatggcgacggcaaacgagaatctgtccgctaagttttgtaatagggttctgaagttctttactaaactctttcagttaaccgaaaaaagccctaacccctcgctgctccacctatgcggctctctagcccagcttgcatgtgtggagccggtgcggctccaggcgtggctgacccgaatgactacctcacccccaaaagattcggaccaattggatgtcattcaggagaaccggcagctgttgcaattactgaccacgtacatcgtcagagagaactctcaggtcggcgagggcgtatgcgccgttctcctgggcacgctcacaccaatggctacagagatgctagccaacggggacggcacaggttttcctgagttaatggtggtgatggccacactcgcctcagctgggcagggggctggacaccttcagttgcacaacgctgcagtggattggctctcaagatgcaaaaagtacctgagtcagaaaaatgtcgtggagaagctgaacgctaacgtgatgcacggcaagcatgtgatgatcctggagtgcacctgccatattatgagctacctggccgatgtcacaaatgctctctcccagagtaacggacaaggtccttcccacttgagtgtggacggggaggagcgggcaatcgaagtggattcagactgggtcgaggaattggcggtcgaggaggaggattcccaggcggaggatagcgacgaggacagcctatgcaataaattgtgcacattcaccattacccaaaaagaatttatgaatcagcactggtatcattgtcacacgtgtaagatggtcgacggcgtcggcgtgtgtactgtgtgcgcaaaggtttgccacaaagatcacgagatctcctatgccaagtatggaagttttttttgtgattgcggcgcaaaagaagacggtagctgcctcgcactggtgaagcgcactccgagctcagggatgagttctaccatgaaagagtctgccttccaatccgagccgcgaattagtgaatcgctggtgcggcacgctagtacctccagccccgcagacaaggccaaagtcaccataagcgacggaaaagtcgccgacgaagaaaagcctaaaaagagcagcctgtgtaggacagtcgagggttgtcgcgaggagctgcagaatcaggccaactttagttttgctccactggtcctggatatgctgaatttcctgatggatgcaatacagacaaatttccagcaggcttccgccgtcggatcttcatcacgcgcacagcaggccctgtccgagctgcacaccgtggaaaaggctgttgaaatgacagaccagctgatggtacctactcttggatcacaggaaggggcttttgaaaatgtaaggatgaactactccggagatcagggccagaccataagacagcttatatccgcccatgttctcagacgcgttgctatgtgcgtgttatccagccctcatggcagaagacagcacctggctgtctcccacgagaaaggaaagattaccgtcctgcagctgtcagctctgctcaagcaggccgactcttcaaaacgcaagctgactttgaccaggttggcatcagccccagtcccttttactgtcctttccctcacaggaaatccatgtaaagaagactacctggccgtgtgcggtcttaaggactgccacgtcttgaccttcagttcgtcaggatccgtcagcgatcatctggtgctgcaccctcagcttgccaccggaaattttatcattaaggcggtgtggttgccgggttcccagactgaactcgctattgtaacggctgattttgtaaagatttatgatctgtgcgtggatgcgctgagtcccacattttatttcctgctgccctcatcgaagatcagggatgttacatttttgtttaacgaggaaggaaagaacataatcgtgattatgtcatctgctgggtacatttacacccagctgatggaggaggcgagttctgctcagcagggtcccttctacgtgacaaacgtgcttgaaatcaaccatgaggatttgaaggattctaactcgcaggtagctggaggtggcgtgagcgtatactattcccacgtactgcagatgttgttcttttcatactgtcagggtaagagtttcgctgccaccatatctcgaacgacattggaggtattacagctgttccccatcaacattaagtcctcaaatggcggttccaaaactagtcccgctctgtgccagtggtcggaagtgatgaaccaccctgggttggtgtgttgcgttcagcagaccacaggggtgccactagttgttatggtgaagcccgatacctttctcattcaggaaatcaaaacgcttccagccaaggcgaaaatacaggacatggtggccatccgccataccgcgtgtaacgagcagcagcgaacgacaatgattctgctctgtgaagatggttcgctacggatttacatggcaaatgtggaaaatacctcctactggctgcagccctccctgcagccgtccagcgtgatctctataatgaagccagtgaggaagcgaaagaccgcaacgatcaccacaagaactagtagtcaggtaacatttccaatcgattttttcgagcacaaccagcagctcactgacgttgaatttggaggcaacgacttgctgcaggtctacaacgcacagcagatcaagcatcggctgaattcaaccggaatgtacgtcgcgaataccaagcctgggggtttcactatagaaattagtaataacaatagtactatggtgatgaccggcatgcgaatacaaatcggaacccaggcaatcgagcgcgctccttcatatattgaaatattcggccgtaccatgcagcttaatctctccaggtctcgatggttcgacttcccctttaccagagaggaggcccttcaggctgacaagaaactcaacctgttcataggggcaagtgttgaccccgcaggagtcactatgatcgatgcagtcaagatttacggcaaaaccaaggagcagttcggctggcctgacgaacctcccgaggaatttccgtctgccagcgtgagtaacatttgtccaagcaacctgaaccagagcaacgggaccggtgacagtgattctgccgctccgaccacgacctccggcacagtcctcgagcggctcgtggttagctcccttgaagctctggaatcatgcttcgcggtcggacctatcatcgaaaaggagcggaataagaacgccgcacaggagttggccactctcctgctctcccttcctgcaccagcctcagtgcagcagcaaagcaagagcctgcttgcttcccttcatacttcccgctccgcctaccactctcacaaagatcaggcactcctgtctaaagctgtgcagtgtcttaatactagttctaaggagggcaaggacctggaccctgaggtttttcagcggttagtgatcaccgcgaggtctattgctatcatgcggccaaataacctagtgcattttacggaaagtaagctgccccagatggagacggaaggaatggacgagggtaaggagccacagaagcagttagaaggcgattgctgtagttttattacacaactcgtgaaccatttttggaaactccacgcctctaaacccaagaatgccttcctggctcccgcttgtctgccaggactgacacatatcgaagcaactgtgaatgccttggtggacattatacatggctattgtacctgtgagttagactgcataaacactgcatccaagatttacatgcagatgctgctgtgccccgacccagccgtgtcattctcctgtaaacaggcactcatcagggtcctaagaccacgcaacaagcgcaggcacgtcactctcccatcatctccaagaagcaatactcctatgggcgacaaagatgacgacgacgatgacgatgctgatgaaaaaatgcagagctccgggatccctaacggaggacatatccgccaggaatcacaagagcagagcgaagtcgaccatggggactttgaaatggtttcagagagtatggttctagaaaccgcagagaatgttaacaacgggaacccatcacctcttgaggccttactagccggtgcggagggttttccacccatgctggatatcccgcctgacgcagacgatgaaaccatggttgagctggccattgctctgagcttgcagcaagaccagcagggaagttctagtagcgctctgggactgcagtcactcggactctccgggcaagctcccagttcgtcgagtctggacgcaggcactttatcagacaccaccgctagcgctcccgctagcgatgatgagggttcaacagcagctacggatggctcaactctgaggacatcgcctgccgaccacggtggcagtgtcggcagcgagtccggagggtctgccgtggactctgtggccggagaacactcagttagtgggaggtcctcggcatacggagacgccactgccgaggggcaccccgcaggacccggatcggtgagctcatctactggcgcaattagtacaaccaccggccatcaagagggggatggaagcgagggcgaaggtgagggcgagacggagggtgacgtgcatactagtaaccgcctccacatggtgcgactaatgcttctcgaaagactgctacagaccttaccccagttgagaaacgttgggggagtgcgggcaattccctacatgcaggtgatccttatgctgacaactgaccttgacggagaagatgagaaggataagggtgcgctcgacaacctgctttcacagttaatcgcagaactcgggatggacaaaaaggatgtctctaagaaaaacgagcgatctgctctcaatgaagttcatcttgtcgtgatgcgcctgctatctgtcttcatgagtcggactaagagtggctccaagtcctccatttgtgaaagcagtagtctgatttcttccgctactgccgcagctctacttagcagcggcgcagtagactactgcttgcatgtgctcaagtccttgctggagtattggaagtcacaacaaaatgatgaagagcccgtagctacctcccagttacttaagccccacaccaccagtagcccaccagacatgtctccattctttctgaggcagtacgtaaagggtcatgctgccgacgtgtttgaggcctatacccagctactcaccgagatggtgttacgactgccatatcaaattaagaagatcacagacaccaattcgcggataccgccacctgtgtttgatcacagctggttttatttcctgagtgagtatcttatgatccagcagaccccttttgttcggaggcaggtccgtaaactcctgctcttcatctgcggctccaaggagaagtacagacagttaagggacttgcacactctggacagtcacgtgaggggcatcaaaaaactgttggaagaacaaggaatctttttacgcgcaagcgttgtaacagcctcctccgggtcagcattgcagtacgacacccttataagcctgatggagcacctgaaggcttgcgcagaaatcgctgcccagcggactatcaactggcagaaattctgcatcaaagacgactccgtcttgtatttccttctacaggtgtcatttttggttgatgagggagtctccccagtcctactgcagctgctctcctgcgctctctgcgggagcaaggtccttgccgctctggccgcttcctctggtagctcatcggccagcagcagctcggcacctgtcgccgcttcatctggacaggccaccacccagtcgaagtcttccaccaagaagtcaaagaaagaggagaaggagaaggaaaaggatggagaaacatctgggagccaggaagaccagctgtgtaccgcactagtcaaccagctcaataagttcgctgacaaggaaactttgatccaatttttacgatgttttctcctggagtcaaattcttcaagcgttaggtggcaggctcattgcttgaccctccatatctacagaaactcaagcaagagccagcaggagctgttgcttgacctgatgtggtcaatttggccagagctccccgcttacggcagaaaagctgcccagttcgtggatctgcttgggtacttttctctgaaaactccgcaaactgagaagaaattaaaagagtatagccaaaaagctgtggaaatattgaggacgcagaatcatattctgacaaatcatcccaactctaacatctataataccctaagtggccttgtggagtttgatggatattacctggagagtgacccctgcctcgtatgcaacaatcctgaggtgcccttctgctatataaaactatccagcattaaagttgacacccggtacactacgacccagcaagtggtcaagcttataggatcccatacaatctccaaagtcaccgtcaagatcggtgacctcaaacgcacgaagatggtcaggaccataaacttgtactacaacaatcggacggtgcaggccattgttgaattaaaaaacaaacccgctagatggcataaggcaaagaaagttcagctcaccccaggtcagactgaggttaagattgacctgcccctgccaattgttgccagcaacctaatgatagaattcgccgatttctacgagaactaccaggcaagcacagagacgctgcagtgccctagatgctccgcttccgtgccagccaacccaggagtgtgcggaaattgcggcgagaacgtttatcagtgccacaagtgtagatctatcaactacgatgagaaggacccttttctatgcaatgcatgtggattttgcaagtatgccagattcgattttatgttatatgcaaaaccttgctgcgcagtagaccctatcgaaaacgaagaggaccgaaaaaaagccgtgtcaaacatcaacacgttgctcgataaagcggatagagtgtatcatcagctcatggggcacaggccccagctggaaaatctgctgtgcaaggttaacgaagcagctccggagaaaccccaagacgatagcggtaccgcgggaggcatttcctcaacaagcgcttctgtcaacaggtacattctgcagctggcgcaggagtattgcggggactgcaagaactctttcgacgagctgtccaaaattatccaaaaggtgtttgcgtcacgcaaggagctgctggaatatgatctgcaacagagagaagccgctaccaagagctcaaggacttctgtacagcctacttttacagcgagccagtacagagcgttaagcgtcctggggtgtggacatacaagctccactaagtgttatggctgtgcctcggctgtgacggaacattgcatcacactgcttcgcgctctggccacgaatcccgctctgaggcacattctcgtgtctcagggactgattcgcgagctgttcgactataatctacggcgaggcgctgccgcaatgcgcgaagaagtacggcaactgatgtgccttttaacgcgggataaccctgaggccacacagcagatgaacgacctcatcatcggaaaagtatcaacagctctcaagggccactgggccaaccctgatcttgcatccagtcttcagtacgagatgctgcttctgacagactcaatctctaaggaagactcatgttgggaactgagacttagatgtgccctgtcactgttccttatggcggtgaacatcaagactcctgttgtcgtcgagaacatcacattgatgtgcctgaggatacttcagaagctaatcaagccccctgctcctacctctaaaaagaataaggatgtgcctgtagaggcgctgaccactgtaaaaccctattgtaatgaaatccatgcacaggcccaattgtggctgaagcgggatccgaaagcatcctatgacgcgtggaaaaagtgcctgccgattaggggcatcgacggtaacggtaaggccccttctaaatcagagttgcgtcacctctatcttacagaaaaatatgtatggagatggaagcagttcctctcacggagagggaagagaacctcccccttagatctgaagcttggtcacaataactggctgcgccaggtcctgtttacaccagctactcaggctgctaggcaggcagcgtgcaccatagtcgaagctctggcaaccattccaagtagaaagcaacaggtattggatttactcacgtcttatctcgacgaactctcaatcgctggggaatgcgctgccgagtacttggcgctctaccaaaagctgattaccagcgcacattggaaagtgtatcttgccgctcgaggcgtgctcccctacgtcggaaacttgattacaaaagagattgcgaggctcctggcactggaagaggctaccctgtccaccgacctgcaacagggatatgctcttaagtccctcaccgggctgctctcctccttcgtggaagttgagtctattaagcgtcactttaaaagcagattggtgggcaccgtgctcaacggatatttgtgtctccggaagctggtggtacagagaaccaaattgatcgacgaaactcaagatatgcttctggagatgcttgaggatatgacaacaggcacagaatccgaaacaaaggccttcatggccgtgtgcatcgagacagccaaacgctacaacctggatgactacagaacgccggtcttcatctttgaaaggctctgttctatcatctaccccgaagaaaacgaagttactgaattctttgtaacactggagaaagatccccaacaggaagatttcctgcaaggccgtatgccaggcaatccatacagttctaacgagcccggaatcggaccactcatgcgagatattaagaataagatctgtcaggactgtgatcttgtggccttgctggaagacgacagcggcatggagctacttgttaacaataaaattatctcactcgatctccccgtagctgaggtatataagaaagtatggtgcactaccaatgagggagagcccatgcgcatcgtttaccgcatgaggggactgttgggggacgccacagaggaattcattgagagcctggactcaaccacggacgaggaggaggatgaggaggaagtctacaaaatggccggagtgatggcgcagtgcggaggcctggaatgcatgctgaatagactggcgggaatcagggacttcaaacaagggcgacacctcctcacagtgctcctgaagctgttctcgtattgtgtcaaagtgaaagtgaatcgccagcagctggtcaagctagaaatgaacactctaaacgtaatgttaggcactctcaacttggctttggtggccgagcaagagagcaaagatagcggcggagctgccgtggctgagcaggtgctatctattatggaaattattctggacgagtctaatgcggagccactgagcgaagacaagggcaacctgttgctgactggtgataaggatcagcttgtcatgctcctggaccagattaactcaacttttgtcagatccaatccttccgtgctgcagggcttgttgcgcatcatcccgtatctcagcttcggggaggtagagaaaatgcagatcttagtggaaagatttaaaccatactgtaacttcgataaatatgatgaagaccacagtggcgacgataaggtgttcctcgactgcttttgtaagatcgctgctggaatcaagaataacagcaatgggcaccaactcaaagatttaattctgcagaagggcatcacccagaatgcgctggattatatgaagaagcatattccctccgccaagaatctggatgccgatatctggaagaagtttctctctcgtcctgctttgccattcatcctacgattactccggggtctggccatccagcatccaggcacacaggttctgattggcaccgactcaatccctaatcttcacaaactcgagcaagtgtcctcagacgaaggcattggcaccctcgctgaaaatctgctggaggctcttcgtgaacaccctgacgtgaacaagaagattgacgccgctcgacgagaaacaagggcagagaagaaaaggatggccatggctatgcggcagaaagcgctgggaaccctcggtatgaccactaacgagaagggtcaggttgtcacaaagaccgcgctgctgaagcagatggaggagctgattgaagagcccggacttacatgctgcatttgccgggaaggatataagtttcagcctaccaaagtcctggggatctacacctttacaaagcgggtggctttggaagaaatggagaataagcccaggaaacagcaggggtactcaacagtttcacattttaatatcgtgcattacgattgtcaccttgcagccgtgaggctggccagagggagagaggagtgggagtccgccgctttacagaacgccaacacaaaatgcaatgggctcctgccagtgtgggggcctcatgttcctgaaagtgcgttcgcaacctgtcttgcaaggcacaatacgtacctccaagagtgcaccggacagcgagaacctacttatcagctgaacatccatgatatcaagttgctgtttcttcgatttgccatggagcaaagcttcagtgctgacactggtggcggaggcagagaatcaaatattcacttaatcccttacataatacacacagtgctatacgtgcttaacaccaccagagccacaagtcgcgaggaaaagaacttacagggctttctcgagcagcccaaggaaaagtgggttgagtccgcatttgaggtggacgggccatactattttacagtactggccctgcatatattacccccagaacagtggagagcaacacgtgttgaaatcctgcggcgtctgctggtcacttcacaggcaagggccgtggctcctggcggagcaacacgcttaactgataaggccgtcaaggactattccgcttacagaagtagtctcctgttttgggccctggtggacctgatctataatatgtttaagaagcaaaccacccccaccgtgggcggaatcgacacggggtctctggaaccatgtgtctgcgaaaaggtgccaaccagcaatacggagggcggttggagctgttctctagccgaatacatcagacataatgatatgcccatctatgaagcagctgataaggctctcaagaccttccaagaagaatttatgccagttgagacattctctgagtttcttgacgtggccggactgctcagcgaaatcacagatccagagtcatttcttaaggatttactgaatagcgtgccgtat

SEQ ID NO: 55698 - DNA, 6176 bp, Artificial Sequence
  Description of Artificial Sequence: Synthetic coding sequence
ttggtgagactgactggcgaccttattgtctggtccgacgagatgaacccccctcaggtcatccgcaccctcctgccactcctgctggagagcagtacagagtccgtggcggagataagcagcaactctctggaaaggattttgggaccagcagagtctgacgaattcctggcccgtgtttacgaaaagttgatcaccggttgctataatatcttagcaaatcacgctgatccaaactccggtttagacgagagtatcctcgaggaatgtctgcagtacctggagaaacagctggagagctctcaggctcgaaaggccatggaggaattttttagcgacagcggcgaactcgtgcagatcatgatggccacagccaatgagaacctgtctgccaaattctgtaatagagtgctcaagttctttaccaaattatttcagcttacagagaagtccccaaacccatcactgttgcatctgtgcggttcgcttgctcaactggcatgcgtcgagcctgtcaggctgcaggcatggctgaccagaatgacaacctctcctcctaaggactcagatcaattagacgtgatccaggagaatcgacagctgttgcaacttctaacgacttatattgtgcgcgagaattcccaggtcggtgaaggggtgtgtgctgtcctgttgggtactctgacaccaatggctaccgaaatgcttgctaacggcgatggcactggtttcccagagttaatggttgttatggctacgctggcttccgctggacagggtgctgggcacctccagctacacaacgctgcagttgactggttgtctcgatgcaagaagtacctaagtcagaaaaatgttgttgaaaagctgaacgccaatgtgatgcatgggaaacatgtgatgattcttgagtgcacgtgccacatcatgtcatatttggccgacgtgacgaatgcattaagtcagtccaacggccaagggccatcccatttgagtgtcgatggcgaggaaagggctattgaggtggacagcgattgggtcgaggagcttgctgtagaagaggaggactcccaggctgaagactctgacgaggactctttatgcaacaagttatgcacgttcaccatcactcagaaggagttcatgaatcaacactggtaccattgccacacttgtaagatggtggacggggttggagtctgtaccgtgtgtgccaaagtctgtcacaaggatcatgagattagttatgcaaagtacgggtcctttttttgtgactgcggagcaaaggaagacggcagctgccttgcactggttaaaagaaccccctcttccggaatgtcatctaccatgaaggagtcagcttttcaatccgagccccgtattagtgagtcgctggtaagacacgcgagcacctccagtccggctgataaagctaaagttactatctccgatgggaaggtggccgacgaggaaaagcccaaaaagtctagcctgtgcaggactgttgaagggtgtagagaagagctgcagaatcaggcaaatttctctttcgcgcctctggtgctggatatgctgaactttctaatggacgcaattcagaccaactttcagcaggcaagtgcagtgggctcaagttcccgcgctcagcaggctctgtccgaactgcacactgtggagaaggcggtcgagatgacagaccagctcatggtgccaacattggggtcccaggaaggcgcatttgagaatgtccgaatgaactactcaggagaccagggtcaaactattcgacagctgatttccgctcatgtgttgagacgtgtggccatgtgcgtgttgtcctccccacatggccgtcgccagcatcttgctgtctcccacgaaaagggcaaaattacagtgctccagctatctgccctgcttaagcaggccgatagttccaagcgtaagcttacactgacccgtcttgcctccgcacctgtgccatttaccgtgctgtccctgacaggaaacccctgcaaggaagattatcttgccgtgtgtggcctgaaggactgtcatgtgctgacattctcatcttctggctcagtgagtgaccacctcgtgttacatccgcagctggcaaccggaaatttcataatcaaagcagtgtggctgcccggatcccagacagaactggcaatcgttactgctgactttgtgaaaatatacgacctgtgtgtcgatgccctgtcaccgactttctactttctcctcccatcctctaagatcagggacgtcacctttctgtttaatgaagaaggaaaaaatatcattgtgattatgtcctctgcagggtacatctatacccagttgatggaggaggcatcctcggcacaacagggcccattttacgttacaaacgtgctcgagattaaccacgaggacttgaaagacagtaatagccaggtcgctggcggaggcgtcagtgtgtactatagtcatgtccttcaaatgctctttttttcttactgccaaggtaaatcctttgctgctacaatatcccgaacaactctggaggtgctgcagctcttccccataaacataaagtcatccaatggcggatcaaaaacctctcccgctctgtgtcaatggagtgaagtgatgaaccacccaggccttgtctgctgcgtgcagcaaactacaggagtgcccctcgtcgtcatggtaaaacccgatacatttcttattcaggagataaagaccctgcccgctaaagccaagatacaggacatggttgccatcaggcacaccgcttgcaatgagcagcagcggacgaccatgattctcctctgtgaagatgggagtctgcggatctacatggccaatgtggagaacacatcatattggctacagccgagtcttcaaccttcctctgttataagtatcatgaaacccgtccgtaaacgaaagacagcaacaattaccactcgaacaagctcccaggtgacattccccattgatttttttgagcacaatcagcagcttactgatgtcgaatttggtggcaacgatctcctgcaggtgtacaatgcgcagcagatcaagcacaggctaaattcaaccggaatgtacgttgccaacactaagcccggtggcttcacaattgagataagcaacaacaatagtacaatggtgatgacgggcatgcgaatccaaattgggacgcaggctattgagcgagcaccatcctatatagaaatcttcggtcgaaccatgcagctcaacctctctcggtcccgctggttcgatttccctttcacaagggaagaagccctccaggcagataaaaagttgaacctgttcatcggcgcttctgtagaccctgccggagtgactatgatcgatgccgttaaaatttacggaaaaactaaagagcaattcggctggcctgatgagcctcctgaggaatttccatcggccagtgtaagcaacatctgcccatccaacctgaatcagtctaacggtaccggcgattctgactccgcagccccaaccacaacaagtggaactgtgttagagtcttcagagacagagagcctgacaaaacttgatcgcttggtcgtctcatccctggaggccctcgaatcttgctttgctgtggggcctatcatcgagaaggagaggaataaaaatgcggctcaggaattagctaccctcctgctctcccttccagcgcctgcttcagtgcagcaacagtcaaaaagtctcctggcatccctacacacttcgcggtccgcctatcactcccacaaagatcaggccctactgtctaaggcagtgcagtgcttgaatacatcatctaaagaagggaaagatctggaccccgaggtgtttcagcgactagtgatcactgccaggagtattgcaattatgcgtccaaacaacctggtgcacttcaccgagtccaaactgcctcagatggaaactgaaggcatggacgagggcaaggaacctcagaagcagttggaaggcgactgctgttcttttatcactcagttggtgaaccacttttggaagctgcatgcctccaagccgaaaaacgcctttctagcccctgcctgcctgcccggactgacccacattgaagccaccgtgaacgcattggtggatatcattcatggatattgcacctgcgaactggattgtatcaacactgcctctaagatatacatgcagatgctcctttgccccgaccccgctgtgtcctttagttgcaagcaagcactcatacgcgttctacgacccagaaataaaagacgccatgtcaccttgccaagcagtccaaggagcaatactcccatgggcgacaaagatgatgatgacgacgacgacgctgatgagaagatgcagtcttctggaattcccaatggtggccacatccggcaggaatcccaagagcagtccgaggttgatcacggagatttcgagatggtgagcgaaagcatggtgctggaaactgcagagaacgtgaacaatggaaatccaagtccgttggaggcactgctggccggtgcagaaggcttcccccctatgttggatattccaccggatgccgacgatgaaactatggtcgaactggccatcgccctctcacttcaacaagatcagcaggccccagccagcgatgacgagggctctactgcggcaacagatggcagcactctgcggacatcccccgctgatcatggcggatctgtgggcagtgagtctggcggatcagcggttgattccgtagcgggagaacattccgtaagtggacggtcatcagcatacggcgacgccaccgcagaggggcaccctgctggccctggtagtgtttctagctcgactggcgctatcagcactacaaccggtcaccaggagggagacggctctgaaggagagggcgaaggcgagaccgaaggcgatgtgcatacctctaaccggctccatatggtacgcctcatgctactggaacggctgctacaaactctgccccagctccggaacgtggggggagtcagagctatcccctacatgcaggtcattctcatgttaaccacggacctggacggggaggacgagaaagataaaggcgctctcgacaacctgctctcccaactcatagccgagttgggtatggacaagaaagatgtcagcaagaaaaatgagaggtcagctctgaatgaggtgcatcttgttgtgatgcggctcttatcagttttcatgtcacgtaccaagagtggtagtaagtcttcgatatgcgagtctagcagcctgatttcctcggccaccgctgcagccctgctgtcctccggggcagtggactattgcctgcatgttctcaagtcactgctggaatattggaaatctcaacagaacgacgaggagcccgtggctactagccaattgctgaaaccccacacaaccagtagccctcccgacatgagcccattcttcctgcgccagtatgtgaaaggacacgctgccgatgtctttgaagcgtacacccaactgctaacagagatggtgttacggctgccctatcaaatcaagaaaatcacagatacaaattcacggattccgcctcccgtcttcgatcactcgtggttctatttcctgagtgagtacctgatgatccagcaaacacccttcgtcagaagacaggtgaggaagttactgctgttcatttgtggaagcaaggagaagtatcggcaactccgggatctgcacaccctcgactcacacgtccgtgggataaagaaattgttggaagaacaaggaatctttttacgcgcatcagttgtgactgccagctctggcagtgcccttcagtatgacaccctgattagtctgatggaacatttaaaggcttgtgcagaaatagccgcacagcgtaccataaattggcaaaagttctgcattaaagacgattccgtactgtatttccttttgcaagtgtctttcttggtcgacgaaggtgtgtccccggtattgcttcagctcctgtcttgtgccctctgtgggtctaaggttctcgccgctttggcagctagctcgggatcatcatctgccagttcttcttccgcgcctgttgccgcttcttccggacaggccactactcagtctaagagttccaccaagaagagtaaaaagta

SEQ ID NO: 55699 - DNA, 5019 bp, Artificial Sequence
  Description of Artificial Sequence: Synthetic coding sequence
agatttctctccactatgaaacagaatgcactccaaggggtcgtgccttctgagaccgaggatttgaacgtggaacacttgcagatgctgctgctcatttttcacaatttcaccgaaaccgggcgacgtgccatcttgtccctgtttgtacaaatcatccaggagctgtccgtgaatatggacgcccaaatgagattcgtgccgctgattctcgctagactgctgctcatcttcgattatctgcttcatcagtactccaaagcacccgtgtatcttttcgagcaggtgcagcataacttgctatcacctcccttcggttgggcgtcagggtcccaagactctaactctcgaagagccacgacacccctgtaccatggcttcaaggaagtggaggagaactggtccaagcattttagtagtgacgccgtgcctcaccccaggttctactgcgttctctcgccagaggcgagcgaggatgacctgaacaggctcgacagtgtcgcctgcgatgtgctattttccaaattggtgaaatacgacgaactttacgcagctctaaccgcattgctggcggctggaagccagttggatactgtgcgaagaaaggaaaacaaaaacgtcacagctctcgaggcttgcgcactacagtactatttcctgattctctggaggatactggggatcctcccaccctccaaaacttacatcaaccagttatcaatgaatagtccagaaatgtccgaatgcgatatccttcacaccttacgatggtcatctagattaaggatttcctcttatgtgaactggataaaggatcatctcattaagcagggcatgaaagcagagcacgcctccagcctcctagaactggcaagcacaacaaagtgcagctcggtcaaatacgatgtggagattgtggaggagtatttcgctaggcagatctcaagcttttgctccattgattgcactactattcttcagctgcatgaaattccgtccctgcagtctatctataccctcgacgctgctatatcgaaggtccaagtgagtctggacgagcacttctccaaaatggctgccgaaactgaccctcacaaatcctctgaaataactaagaacttgctgcctgcaacactccaacttatcgacacttatgcgtcattcactagggcgtaccttctacagaacttcaacgaagaagggaccacagagaaaccgagtaaggagaaactccagggcttcgcagcagtgttggcgattgggtcctctcgatgtaaggcgaatactctgggtcccactctggtgcagaacttgccttctagcgtacaaactgtgtgtgagagctggaacaatatcaataccaacgagtttcctaacatcggctcatggagaaatgctttcgctaacgatacaatcccctccgaaagttacatcagtgcagtccaggcagcccacctggggacattatgctcccagtccctgcctttagcggcatcacttaagcatactctcttaagtctcgtgcgactaacgggagacttgattgtgtggagtgacgagatgaaccccccacaggtgatacgcacactgcttccattgctactggaatcctctacggaatctgtggcggagatctcatctaacagcctggagcggatcctcgggcctgctgagagcgacgaatttctcgctagagtgtacgagaagctaattacaggctgctacaatatacttgctaaccacgcagaccccaactctggcctggacgagagcattctggaagaatgtcttcagtatttggagaagcagctagagagcagtcaagccagaaaagccatggaggaattcttctctgactctggggaactcgtacaaatcatgatggctactgcgaacgaaaatctctcagcaaagttttgtaaccgggtcttaaagttcttcacaaaactgttccagctaacagaaaaatcaccaaacccatcattgctgcacttgtgtggcagcctggctcagcttgcatgcgttgagccggtcagactgcaagcgtggctcacaaggatgacgaccagccctccaaaggactcggatcagctagacgtcattcaggaaaaccggcaactccttcagttgctcactacatacatcgtgagggagaactctcaggtgggagaaggcgtttgtgctgtattgctgggaactctcacacctatggcaacagagatgctcgccaacggggatggaactggtttccctgagttgatggtggtgatggctacattggcatccgcaggacaaggggctggccacctccagttacacaatgcagcagttgactggttatctaggtgtaagaagtatctgtcacagaagaatgtcgttgaaaaactgaatgccaatgtgatgcacgggaaacatgtgatgatactcgaatgcacatgtcacataatgagctacttagctgacgttaccaacgcgctctcccagtccaacggtcagggaccatctcacttaagtgttgatggggaggaaagagccatcgaggtcgacagtgactgggtggaagagctcgccgtggaggaggaggattcacaggccgaggactccgacgaggactccctgtgcaacaagctgtgcacctttacaatcacacagaaggagttcatgaaccagcactggtatcactgtcatacctgcaagatggtcgacggcgtcggtgtatgcactgtctgcgcaaaggtgtgccacaaggaccacgaaatcagctacgcgaagtacgggagtttcttctgtgattgcggggcaaaggaggatggttcatgccttgcactagttaaacgaacaccgtcttccgggatgtcctctacaatgaaagagtctgctttccaaagtgagccacgtatatccgaaagcttggtacgacacgcctccaccagcagccctgccgacaaggctaaggttacgatctccgatgggaaggtggccgatgaagagaagcctaaaaagtcttccttatgtagaactgtggaaggatgcagggaagagttgcaaaaccaggctaattttagctttgcaccactcgttctagatatgctgaatttcctgatggatgcaatccaaaccaatttccagcaggcttccgccgtgggaagttcaagtcgagcacagcaggcactgagcgagctgcacacggtagagaaggcagtggaaatgaccgaccaactcatggttcccactctgggaagtcaggaaggcgcatttgagaatgtaaggatgaattattccggagaccaggggcaaactattcggcagctgatttctgcccacgtccttcggagggttgctatgtgcgtgttatcttcccctcatggtcgcaggcagcacctcgccgtgagccatgagaaggggaagattaccgtccttcagctctcagctctgttaaagcaggccgatagctcaaagcggaaactcaccttaaccagattagcatctgcacctgtgccattcaccgtgctgtcactcaccgggaacccttgtaaggaagattacttggccgtgtgtggcctcaaagactgtcatgtgcttacttttagttcatcaggctctgtgagcgatcaccttgtccttcaccctcaactcgctaccggcaatttcattattaaggctgtctggttaccgggtagtcaaaccgagttagcgattgtcaccgctgattttgtgaagatctatgatctgtgcgtagatgctctgtcccccaccttctactttctgcttcctagcagtaagataagggacgtgacttttctatttaacgaagaaggtaagaacattattgtcataatgtccagtgctggttacatctacacccagctcatggaggaggcgtctagcgcccaacagggaccattctacgtgaccaacgtcctggagatcaaccatgaggacctgaaacaggacagcaatagccaagtggccggaggtggtgtgtctgtatactattcccatgttttacagatgctcttcttttcctattgccagggcaaatcgttcgctgctaccataagtcggacaacgctggaagtgctgcaactgttccctataaacatcaagtcatctaatggaggtagcaaaacctctcccgcactgtgtcagtggtctgaggtcatgaatcaccctggcttagtgtgctgtgtgcagcagaccaccggagtgccccttgtagtaatggtgaagcctgatacattcctgatccaagagatcaaaacgttgcccgcaaaagcaaagattcaagatatggtcgcaattcgtcatactgcctgtaacgaacagcaaaggaccactatgatccttctctgcgaggatggcagtctgcggatttacatggcaaacgtggaaaacacatcttactggctgcaaccaagtctgcagcccagcagcgtgatctcaatcatgaagcccgtgaggaagcggaaaaccgcaactattacaaccagaacctcctctcaggtcacattccccatcgacttcttcgagcacaatcaacagctcaccgacgttgaatttggcggtaatgacttgctacaggtctacaacgctcagcagattaagcacaggctgaactccaccggcatgtacgtcgctaataccaaacccggagggtttacaatagaaatctctaataataatagcaccatggtgatgaccggaatgcggatacaaattgggactcaggccattgagcgcgcaccatcctacatcgagatcttcggtcgaacaatgcagctcaacctcagccgctcgcggtggtttgatttccctttcaccagagaggaggcactccaggccgacaaaaagctgaatctgttcagcgaaagtcctacccctggggctgattccgttctgatagtgactgctaagttgggtgctaccggcctctggctcagcaacatcctaggcagcttgcattccgcagatttctccgtgctcagctccgggaattttgagctccacttgatgtattag

SEQ ID NO: 55700 - DNA, 2955 bp, Artificial Sequence
  Description of Artificial Sequence: Synthetic coding sequence
gatttcccttttactcgtgaggaggctttgcaggccgacaagaaactgaatctctttataggcgcatctgtcgaccctgccggtgtcactatgatcgatgctgttaagatctatggcaaaactaaagagcaatttgggtggccagacgagccgcctgaagaatttccaagtgccagcgtttcaaatatttgtcctagcaatctgaatcagtctaatggaacaggggacagcgattcggcggcacctacaactactagcggtactgtcctagagcgcctggtggtgagttctcttgaagcccttgagtcttgttttgccgtggggcctatcattgagaaggagcgcaacaaaaacgctgcccaggagctggctaccttgctgctatctctgccagccccagctagtgtgcagcaacaaagcaaaagcctcctagcaagcctccacacttcaagatctgcgtatcattctcacaaggaccaagccctgctgtctaaagccgtgcagtgtctgaatacaagctccaaagagggcaaagatctcgatcccgaggtattccagaggctagtgatcacagctagaagcatcgccatcatgcgacctaacaacctcgtgcatttcactgagtcaaagcttcctcaaatggagaccgactgtttttttcccaggtgcgcctgttggagccttggcatcgtgggtatcttgatcggagccccactagagaccccgagtcccgaaggcatggacgaagggaaagagcctcaaaagcagctggaaggagattgttgcagcttcatcacacagctcgtcaaccatttctggaagctacatgcatctaagccaaagaatgccttcctggctcccgcttgtctgcctggcctcactcacattgaagcgacagtgaatgccctcgtggacataattcacggatattgtacctgtgaactcgactgtatcaataccgcttcaaaaatctatatgcagatgctgctctgccctgacccagccgtctcgtttagttgtaaacaagccctaatcagagtgctacgaccacgaaataaacgtcgccatgtcacactgccttcctcaccaagaagcaatactccgatgggggacaaggacgacgacgacgatgacgacgcagacgagaaaatgcaatcctctggaatcccaaacggtggtcatattcggcaagaatcgcaggagcaatctgaagtcgaccacggggacttcgagatggtctcagagtctatggtccttgagacagccgagaatgtgaataatggcaacccctccccgctggaagctctgctcgcaggcgcagaaggcttcccacctatgctggatattccccctgacgccgacgacgaaacaatggttgagctggccatcgcgctgtcgctgcagcaggatcaacaagcaccagcttcagatgacgaaggtagcaccgccgcaaccgatggaagcactctcaggacctcccccgctgaccacggaggttctgtaggtagcgagtctggcggttccgctgtcgactctgtggctggagaacactccgtcagcggaaggagctcagcttatggcgacgccacagccgagggccacccagccggtccgggatctgtttcatcctcgacgggcgcaatctctacaaccacaggtcatcaggaaggagacgggagcgagggagagggtgaaggcgaaacagagggtgatgtgcacacgtccaaccggcttcacatggtacggctcatgctgctagagcgcctgctgcaaacactgccccagttacgtaatgtcggtggcgtccgcgcaattccctatatgcaggtgattctgatgctcaccaccgatctggatggggaggacgagaaggacaaaggcgctctggacaacctgttatcgcagttgattgcggagctgggcatggataaaaaggacgtctctaaaaagaacgagcggtcagcgctcaacgaagtgcacctcgttgttatgcgtctgctgtccgtctttatgtcaaggactaagagtggctccaaatccagcatctgtgaatccagtagcctgatctcttccgcaactgccgctgctttgctgtcctccggtgccgtggattactgcctccacgtgctgaagagcctgttggaatattggaagtcacagcagaacgacgaggagcccgtcgcaacatcacagctcctcaagccacatactacctcctcaccgccagatatgagtccgttttttcttcggcagtacgtgaagggacatgcggcagacgtgttcgaggcttacactcaactcctgacggaaatggtgctccgattaccatatcagattaagaaaattaccgatactaattcccggattccacctcccgtgttcgaccactcctggttctacttcctgagcgagtacctgatgatacagcagacaccttttgtccgccgacaggttaggaagttgctacttttcatctgtggctccaaggaaaaatatagacagctgcgagacctgcacacgctggattcccatgtgcggggaattaagaagctattggaggagcaaggtatcttcctgcgggcttccgtggtgacagcgagttcgggtagcgccctgcaatatgatactcttattagtctgatggagcacctgaaagcctgtgctgaaatcgctgcccagcgtactatcaactggcagaagttttgtataaaggatgactccgtgctgtatttcttactccaagtctctttcctggtggacgagggtgtctcacccgtgctccttcaactactatcatgtgccctgtgtgggtctaaagtcttggcagcccttgcagcgagctcaggctcgagttcagctagttcctctagcgcacctgtggcggctagttcaggtcaggccacgactcaaagtaagagttcaacaaaaaagtctaagaaagaagagaaggagtag

SEQ ID NO: 55701 - DNA, 2121 bp, Artificial Sequence
  Description of Artificial Sequence: Synthetic coding sequence
atgaggatcgtttataggatgagagggctcctcggagacgccacagaggagtttatagagagtttggacagtaccaccgatgaagaggaagacgaagaagaagtatataagatggcaggagtcatggctcagtgtggcggactcgaatgcatgctgaaccgacttgcaggaatcagagatttcaaacagggcaggcacttgctgacagtgttactcaaactgtttagctattgtgtaaaggtgaaggtcaatcgacagcagcttgtaaaactggagatgaacaccctgaacgttatgctcggaaccctcaatctcgggaacctcctgttgacaggtgacaaggatcaactggtgatgctgcttgatcagatcaacagcacatttgtacggtcaaacccttccgtactacaaggcctactgagaatcattccttacctgtcatttggcgaggtcgagaaaatgcagatcctcgtggagcggttcaaaccttactgcaatttcgataagtacgatgaggaccatagtggcgacgacaaggtgtttttagattgtttttgtaaaattgctgccggaattaagaacaattctaacgggcatcagcttaaagacctgatcctgcagaaagggattacccagaatgctcttgactacatgaaaaagcatattccctcagctaagaatctcgacgcagacatctggaaaaaattcctgagccgtcctgcacttccttttatactccgcctcctgcggggtctggccattcagcatcccggtacccaggttctgatcgggactgattccatcccaaatttgcacaaattggaacaagtatcaagtgacgaagggatcggtacacttgccgagaacctgctggaggctctgcgtgagcaccctgatgtgaataagaagattgatgccgcaaggagggaaaccagggcagaaaaaaaaaggatggccatggccatgcgacagaaggctttgggaactctaggtatgacgacaaatgaaaagggccaagttgttactaagacagcattactgaagcaaatggaggaacttatcgaagagcctgggcttacttgctgcatctgcagggagggatacaaattccagcctacaaaagtccttggtatttatacatttactaagagagtcgcattggaagagatggagaacaaaccccgaaagcagcagggttattctaccgtgtcacactttaacattgtgcactatgattgtcacctggcagccgtcagactcgctcgcggacgagaggaatgggagagcgccgcactccagaatgctaacactaagtgcaatggcctcctcccggtgtggggcccacacgtgcctgagtccgcatttgccacctgcctggctcggcataacacctacctgcaggaatgtaccgggcagcgggaacccacatatcaactgaatattcacgacataaaattattgtttctgagatttgctatggagcagtccttcagcgctgacacaggaggtggaggcagagaatcgaacattcacttaatcccctacataatccatacagtgctctatgttctgaacacaaccagagcaacatcccgcgaggaaaagaatctacagggatttttggaacagccaaaagaaaagtgggtggagagcgctttcgaggtcgacggcccttactattttaccgtattggctctgcatatcctgcctcccgaacaatggcgcgctacaagagtcgaaattctgcgcagactgctcgtcacttcccaggcacgggctgttgcccctgggggagctactcggctgacagataaggctgtcaaggattatagtgcctatcgctcctctctgctgttctgggccctcgttgacttaatctataacatgttcaagaaagtccccacctcaaacacagaggggggatggagctgctctctggcagaatacatccgccacaacgatatgcctatctatgaagctgcagataaagctctgaagacgtttcaggaggaattcatgcccgtggagaccttcagtgaatttcttgacgtcgccggattgcttagcgagattactgatccagagtctttcctgaaagatctgctcaactccgtgccctag

SEQ ID NO: 55702 - DNA, 2544 bp, Artificial Sequence
  Description of Artificial Sequence: Synthetic coding sequence
atggcagtgtgtatcgagacagcgaagagatataatttagatgattacagaacaccggtgtttatcttcgagagactgtgctccattatctatcctgaagaaaatgaagtgactgaatttttcgtcaccctcgaaaaggaccctcagcaagaggattttttgcaaggtaggatgcccggtaacccatactcctcgaacgagccgggaatcggcccactgatgcgggacatcaagaacaaaatctgccaggattgtgacttggtggccctgctggaagacgatagcggcatggaaggtgagcctatgcgcatcgtctatagaatgagagggttactgggtgacgctacagaagagtttatcgaaagcctggattccaccaccgacgaggaggaagatgaggaggaggtctataagatggccggtgttatggcacagtgcggtggcctcgaatgcatgctgaataggctggccggaatacgagacttcaaacaaggcagacacctacttacagtgctcctaaaattgtttagctactgtgtgaaagtgaaggtaaaccggcagcaacttgtaaaacttgaaatgaacactctcaacgtaatgctcgggacgctgaatttggctctggtggctgagcaagaatctaaggacagtggcggtgctgccgtggcggagcaggtgctctccataatggaaatcatcttggacgaatccaacgccgagcccctgagcgaagataaaggaaacttattgctgacaggcgacaaggaccaattggtaatgctattagaccagatcaatagcacatttgtccggagcaatccatccgtgctgcaaggtctgcttagaatcatcccttaccttagcttcggagaggtggagaaaatgcagatccttgttgagcggtttaaaccctactgcaactttgacaagtatgatgaagaccactctggagatgataaagtctttctagattgtttttgtaaaatcgcagctgggataaaaaacaattctaatggccaccagctgaaggacctcattctgcaaaaaggcataacacagaacgcactggactatatgaagaagcacattccttctgccaaaaacttggacgccgacatctggaaaaagtttctctctcgcccagcactcccttttatcctgagactgttaagagggcttgcaatccagcaccctgggacgcaggtactaattggcaccgatagcatccccaatctgcacaaactcgaacaggtgagctccgatgagggaatcggaaccttggcagagaaccttctcgaggcccttagggagcatcctgatgttaacaaaaaaatagacgctgctcggagggagacgagagcagaaaagaaacgtatggccatggccatgcggcagaaggcactaggaactctgggcatgaccaccaatgagaagggccaggtggttacaaagacggcactgctgaaacagatggaggaacttattgaggaaccagggcttacctgctgtatttgcagggagggctacaaatttcagccgacgaaggtcttggggatttacactttcaccaaacgcgtcgctctggaggagatggagaacaagccacgaaagcagcaaggctatagcactgtttcccactttaatattgtacattatgattgtcatctcgctgcagtgagattggccaggggacgggaggaatgggagagtgccgctctgcaaaacgccaataccaaatgcaatgggcttttgccagtgtggggaccccatgttccagagagcgcctttgccacttgtctagcccgacacaatacatacttacaggagtgtacagggcagcgggaacctacctatcaactgaacattcacgacataaaactcctgttccttagattcgccatggaacaatccttctcagccgacactggtggaggagggagagaatccaacatccacctgattccctatattatccacacagttctgtacgtcctcaacaccaccagggctacatccagagaggaaaagaacttgcaggggttcctggagcaacccaaggagaaatgggtcgagagtgcatttgaagttgacggcccatactatttcaccgtgctcgccctgcatatcctgcccccagagcagtggagggccacgcgcgtggagatcttgcgccgtcttctcgtgacatcccaggccagagcagtggcccctgggggtgctacaagactgacagataaagcggtgaaggactactccgcctatcggtcttctttgctcttttgggccctcgtggatctgatctataatatgtttaaaaaagtccccacgtctaacactgaggggggttggtcttgcagtctcgcagagtacattcgccataacgacatgcctatctatgaggcagcagacaaagccctaaagacctttcaggaagagttcatgcctgtggagaccttcagcgagtttctcgatgtggccggattgttgtctgagattactgaccctgagtcattcctaaaggacctgttgaattcagtgccttag

SEQ ID NO: 55703 - DNA, 3957 bp, Artificial Sequence
  Description of Artificial Sequence: Synthetic coding sequence
atgtccggaggcgcaagtgctacgggcccacgcagaggcccacccggactcgaagacactacaagcaaaaaaaagcagaaggatagagcgaaccaggagtctaaagacggcgatccacggaaggagaccggttcccgttacgtcgctcaggccggtctcgagcctcttgcttctggagacccaagcgcctcggcgagccacgcagccggtattacaggctccaggcaccggactcgactgttcttcccgagttcttcaggctccgccagcactccccaagaagaacagaccaaggagggagcgtgtgaggaccctcacgacctgcttgccacacccacacccgagctgcttttagactggagacagtctgcagaagaagtgattgttaagctgagagttggggtgggtccccttcaactggaagacgtagatgcggcattcaccgataccgattgcgtagtccgtttcgccggtggccagcaatggggtggcgtgttctatgccgagattaagtcttcttgtgcaaaagtccagacaagaaagggttctcttctgcacctcacgctgccgaagaaagtccccatgctgacatggcctagcttattagtggaggccgatgaacaactgtgcatacctccactgaattcccagacatgtctgctgggcagtgaggagaacctggccccattggccggagaaaaagcagttccgccaggcaacgaccctgtttcccctgccatggtccgcagtcgcaacccaggcaaggatgactgcgccaaggaggaaatggccgtcgccgctgatgcggctacgctggtggacgagcctgagtccatggtcaatctggccttcgtgaagaatgatagttacgagaagggtccagattcagttgttgtgcatgtctatgtgaaggagatttgcagagatacaagtagagtgctgtttagagagcaagacttcacactcatcttccaaacacgcgacggaaattttctgagattgcatcccggttgcgggccacacaccaccttccgttggcaggtgaaactaagaaacctaatcgagcctgagcagtgcaccttttgctttacagcctcaagaattgatatatgtctgcggaaaagacaaagtcaacgttggggcggtctggaggcaccagccgcacgagtgggaggcgctaaggtcgccgtgccgactgggccaactccactagatagtactccaccaggaggagcgcctcaccccctaaccgggcaggaagaagcacgagcagttgagaaggacaaatccaaggcccgttctgaagacacgggcctggactccgttgccacgaggacgccgatggagcacgtcaccccgaagcctgagacacacctggccagcccaaaacccacatgcatggtgcctccgatgccccacagccctgtgagtggggacagcgtcgaagaggaagaggaggaggagaagaaggtttgcctgccgggattcactggcctggtcaatctaggcaacacgtgcttcatgaacagtgtgattcagtccctgtctaatacacgggaactgagagacttcttccacgaccggtccttcgaagcggaaattaactataacaaccccctcggaacgggcggacggctggccatcggatttgctgtgttacttcgagcgctgtggaagggaacccatcatgcattccagcccagtaagctcaaggcaatcgtggccagcaaggcatcccagttcaccggttatgcccagcatgacgctcaggagttcatggctttcctcctggacggactgcatgaagatctgaacagaattcagaacaagccttacaccgaaacggtggactcggacggtaggccggatgaggtagttgctgaggaggcatggcagaggcacaaaatgaggaatgattcctttattgtggaccttttccaagggcagtataagtctaaactcgtgtgtcctgtgtgcgctaaggtttctataactttcgaccctttcctctatctccccgtgcctttaccacagaagcagaaggttctgcccgtattctacttcgcacgcgagccccactctaagcctatcaagttcttggtgtccgtcagcaaagaaaatagtacagcttcggaagttctggactcccttagtcagagcgtgcatgtgaaacccgaaaacctcagactggctgaagtaataaagaatcggttccacagagtgttcctgccctctcacagtctggataccgtgtctccctcagacaccctgttatgtttcgaactgttatcatccgagctcgctaaggagcgcgtagttgtgctggaggtgcaacagcgtccccaagtcccgtctgttcctatctcaaaatgcgcagcttgccaacggaagcagcaaagcgaggacgaaaagctcaaacgatgtacgaggtgttatcgggttggctactgtaatcaactgtgtcaaaagacacactggcccgaccacaagggactgtgcaggcccgaaaacatcgggtacccattcctcgtgtcggttcctgctagcagattgacatatgcacggctggcccagttgctggaaggctatgctcgatacagtgtaagcgttttccagcctccattccagcctgggaggatggccttggaatcgcagagccccggatgtacaactctgctcagcacaggtagtcttgaagcgggtgactccgagagagatcccatacagccccctgagcttcaactggtgacccccatggctgagggggataccggcctccccagagtgtgggcagcacccgatcggggtccagtcccatctacatctggcatatctagtgagatgctggccagcggtcccattgaggtgggttcactgccggctggcgagcgggtcagccggcctgaagccgctgtgccagggtaccagcaccccagcgaggctatgaatgcccacacacctcaatttttcatctacaaaatcgattcaagcaatcgagaacagaggctggaggataaaggagatacccccctggaactgggggacgattgttccctggctctcgtttggcgaaataatgagaggcttcaagagtttgtgctggttgccagcaaagagctcgaatgcgcagaggaccccggatcagctggagaagcagcacgagcaggtcacttcacactggatcagtgccttaatttattcactcgcccagaggtactggctcccgaggaagcctggtactgtccccagtgtaaacagcaccgggaagcttcaaaacagctcctcctgtggcggctgccaaacgtgctgattgttcagctcaagcgcttttcgtttaggagtttcatctggagggacaaaatcaatgatctggtcgagttccccgttaggaatctggatctgagtaagttttgtatcggccagaaagaagagcaactcccatcttacgacttatacgccgtcataaatcattacggaggtatgattggaggccattacacagcgtgcgcccgactccctaatgacagatctagccaaagatcagatgttgggtggagacttttcgatgattctacagtgaccactgtcgatgagagtcaggtggtgactcggtacgcttacgttctgttttaccggaggcgcaattccccagtggagaggcccccacgagctggacactctgagcaccatccggacctcggtccagccgctgaagcggctgccagtcaggcctccaggatttggcaggagctcgaggctgaagaggagccagtgcccgaagggagtggccctctcggcccatggggacctcaggattgggttggtccattgcccagagggcctactacgccggacgaaggctgtttgagatacttcgtactgggaaccgtggcagcactcgtggccttagtcctgaatgtattctatcctcttgttagccagagtaggtggcggtag

SEQ ID NO: 55704 - DNA, 1548 bp, Artificial Sequence
  Description of Artificial Sequence: Synthetic coding sequence
atgtccggtggggcttcagccacaggtccacgcaggggcccaccagggttagaggatacaacgtctaagaagaagcaaaaggaccgagccaaccaggagtccaaggatggtgatccacgtaaagagacaggcagccgctatgtcgcccaagctggactggaacccttggcatcgggagatccctccgcctcggccagccatgcagctgggattaccggtagccgccacaggacaagacttttcttcccctccagcagtggtagcgccagcacaccacaagaggaacagaccaaggaggagttactgctggattggaggcagtctgctgaggaagtgatcgtgaaactgcgagtaggcgtcgggccactgcagttggaggatgtcgatgccgcttttactgataccgattgcgtggtgagattcgctgggggtcaacagtggggcggtgtcttctatgcagaaattaaatcgtcatgcgccaaggtacagactagaaagggttctctcctgcacctgaccttgcccaagaaagtgccaatgctgacgtggccttctctgctgaaaaaacccctcgggacacaggaattggtgcccggtctccgttgccaggaaaatgggcaggagctgtctcccatcgccctcgaaccagggcctgagccacatagggctaaacaggaggctagaaatcagaagagggcccagggccgaggggaggtcggcgctggggcaggaccaggagcccaggccggtcccagcgctaaaagagctgtgcacttgtgccgaggtccggagggcgacggttctagggacgaccccggaccccgtggtgacgcaccacccttcgtcgctgatccagctactcaagtcgaagctgacgaacagctgtgtattcctcccctgaatagtcaaacttgcctgctggggtccgaagagaatctggcccctctggcaggggaaaaagcagtgccacccggaaatgaccccgtaagccctgccatggtccgctcacgaaatcccggaaaggacgattgcgctaaggaggaaatggcggttgctgcagacgccgcaaccctcgttgacgagccagaaagtatggtgaacctcgcgtttgttaagaatgattcatacgaaaagggcccagacagtgtcgttgtacacgtatacgttaaggaaatctgtagagatacttcccgtgttttgttcagggaacaagatttcacacttatattccagactcgagacggaaattttttaagactccacccaggttgcggcccacacaccacctttaggtggcaggtaaagctcaggaacctcatcgagcccgagcaatgcactttctgcttcacagcctctcgcatagacatctgcttgcgaaaaagacagtcacaacgctggggccctggcggaccaggctgtacaagatgctcaggctggtgcaagggttgtagagcagatcgttccaatccttcagggtttaatcctacccgtcgctgtagcccaccgcctgatcgtcctggcggagggccaggctgcggcgaaggctag

SEQ ID NO: 55705 - DNA, 4155 bp, Artificial Sequence
  Description of Artificial Sequence: Synthetic coding sequence
atgtccggaggcgcttctgccacagggcctagacgcggtccacctggactggaggataccacttcaaagaagaagcagaaagacagagctaatcaagaaagcaaggatggcgaccctcgcaaagagactggctcaaggtacgtggcccaggctggtttggaaccactggcaagtggtgacccgtcagcctccgctagccatgcagccggaattacaggtagcaggcatagaacgcgcctgttcttccccagctcttccggaagcgccagcacgcctcaagaggagcaaacaaaggagggtgcctgtgaggatccacacgacctgctggccacccccacccccgagctgctgttggattggcgacagtctgcagaggaagtgattgtaaagttaagagttggcgtgggacctctgcagttagaagatgttgacgctgctttcaccgataccgattgtgtcgtgcggttcgcaggtgggcagcagtggggtggcgttttttacgcagaaataaagtcttcgtgcgctaaagtgcaaacaagaaaggggtcattgctgcatctcacattacctaagaaagtccccatgctgacatggccaagtttgctgaaaaaaccgctgggtacccaggagctcgtgccgggactgcgctgtcaggaaaatggacaagaactgagccctattgccctggagcctgggccagaacctcacagagctaaacaggaggccaggaaccagaagcgcgctcaaggccgaggcgaggtcggcgctggcgctggtcctggggcacaggcgggtcccagcgcaaagagggcggtgcatctatgtcgcggaccagaaggagacggtagccgcgacgatccagggccacggggtgatgcaccgcctttcgtggccgatccagcaactcaggtcgaggccgacgagcagctgtgcatcccccctctgaactcacagacatgcctgcttggctcagaggagaacttggcccctcttgctggagagaaggctgtcccccctgggaatgaccctgttagtcctgccatggttagatccaggaaccccggtaaggacgattgcgctaaagaggaaatggcagtcgcggctgacgcagcaacccttgttgacgagccagaatctatggtaaacctggcatttgtcaagaacgattcctacgaaaaaggccctgattctgtcgtggtccacgtgtacgtcaaggaaatctgtcgtgacacgtctcgggtgttgttcagagagcaagacttcacactgatattccaaacccgcgacggaaattttttgagactgcacccgggatgtggaccacacacgactttccgttggcaggttaagctgcggaatcttatcgagccagaacagtgtacgttctgctttacggcgagccgcatagacatttgcttgaggaagagacagagccagcgttggggaggcttggaagccccagccgcaagaggcgcagtgggaggagctaaggtggcggtgcctacgggacctacccccttggatagcactccccctgggggagcgcctcacccacttacaggccaagaggaagctagagccgtggaaaaagataagtccaaggctcgttcagaggatactgggctggactctgtggctactagaactcccatggagcacgtaactccgaaacccgaaactcacttggcctcgccgaaacccacctgcatggtgccaccaatgccgcattccccagtgagtggcgactcagtggaggaggaggaagaggaggagaaaaaggtttgtttacctggcttcaccgggctggtgaatcttggaaatacttgtttcatgaattcagtgatccagtcactcagcaacacaagggaactgagagacttctttcatgatagaagttttgaagccgagattaattataacaacccactgggtaccggtggcaggctggctataggctttgctgtcctgctgagagcactctggaaaggaacgcaccatgctttccagccgagcaaactcaaagctatcgttgcctcaaaggcaagccagtttaccgggtatgctcagcatgatgctcaggagttcatggcgtttcttcttgacggtctgcacgaggacctgaatagaatccaaaacaaaccatatacagaaacagtggattccgacgggagaccagacgaagtggtagccgaggaagcttggcaacgtcataaaatgcgtaacgactcgttcatcgtggatctgttccagggccagtacaaatcgaagctcgtgtgtcccgtgtgtgctaaggtttccatcactttcgatccgttcttgtacctgccagtgccactcccacagaagcagaaagtattgcccgtgttctatttcgcccgagaaccacactcgaaacccattaagtttttggtgagcgtctccaaggagaattcgacagctagcgaggtactggatagcttgtcgcagagcgttcacgtaaaaccagagaacctgcgactggcagaggtgattaagaatcgctttcaccgtgtcttcctcccctcacattccctggacaccgtgtccccttccgacacattactttgctttgagctgctgtcctcggaattagctaaagagagagtcgtagtgttggaggttcagcaaagaccacaggtccctagcgtccccatatccaagtgcgctgcctgccagcggaaacagcaaagtgaggatgagaagctgaagcgatgcactcggtgctatagagttggctactgcaatcagctatgccagaagactcattggcctgatcataagggtttgtgcagacctgaaaacataggatatccatttctggttagtgtccccgctagccgcctgacatatgccaggctcgcccagttattggaggggtacgcacgatacagtgtctccgtgttccaaccccctttccagcctgggagaatggccttggagtcacagtctccgggatgcaccacgcttctaagcacgggttcattagaggccggtgactccgagcgggaccccattcagcctcccgaactccagctcgtgactccaatggcggagggggataccggcctgcctagggtgtgggccgctcccgatcggggaccagtgccgagcacatctggcatctcaagcgagatgttggcgagcggacccatcgaggtgggctcactgcctgccggagagagagtctctagacctgaggctgccgtcccgggataccagcatcctagcgaggcaatgaatgctcacacgccacaattctttatctacaagattgatagcagtaacagggagcagcgcctggaggataaaggggacacccccctggaattaggagacgattgttctttggcccttgtgtggcggaacaacgagaggctgcaggaatttgtgcttgtggctagcaaagagctggagtgcgcggaggatcccggttcagccggtgaggcagctcgcgcaggccactttacattagatcagtgcctgaatctctttacgagacccgaagtactcgcccctgaagaggcttggtactgtccgcagtgcaagcagcatagagaggcaagcaaacagttgcttctgtggaggctcccaaacgtgcttatagtccagctcaaacgtttctcctttagatccttcatctggcgcgacaagatcaacgacctggtggagtttcctgtacggaacctggatctctctaaattctgtattgggcagaaagaagaacagctgccaagctacgatttgtacgccgtgataaaccactatgggggtatgatcggcggacattatactgcctgcgcccgactacccaacgacaggagctctcagagatccgatgtcgggtggcgtctgtttgacgactcaaccgtgaccactgttgacgagagtcaggtggtaacccgatatgcatatgttcttttttaccgccgacgtaattcccctgtcgagagaccccctagagccggacacagcgagcaccatccagatctgggcccagcagccgaagcagctgcctcacaaggcctcggccctggacaagcgcctgaggtggccccaacccgcaccgcgcctgagcgctttgcccctccggtagaccgaccggctccaacttacagcaacatggaggaggtcgactag

SEQ ID NO: 55706 - DNA, 4260 bp, Artificial Sequence
  Description of Artificial Sequence: Synthetic coding sequence
atgtctggcggtgcctcagcaacaggcccaaggaggggcccaccgggactcgaagatacgacctccaaaaagaagcagaaggatagagctaatcaggaatccaaagacggggaccctcgcaaagaaacaggaagtcgctatgtcgcgcaggccggactggagcctcttgcttccggagaccctagcgcctccgcttctcacgctgccggtattacaggctctcggcaccgaaccaggctgtttttcccttcaagcagcggatctgccagcaccccccaggaagagcagacaaaggaaggcgcttgtgaggaccctcacgatctactggccacccccacccccgagttgctgctggactggagacagagtgcggaggaggtcatcgtcaagctcagagtgggcgtaggtccgctgcagctcgaggatgttgacgccgcattcaccgacacagactgtgtggtgaggtttgccggtggtcaacagtggggtggagtattctacgccgagattaagagctcgtgcgcgaaagttcagacccggaagggcagcctgctgcacctgaccctccccaaaaaggtccctatgctcacgtggcctagtctgttaaagaagccactgggaactcaggaactcgtaccgggtttgaggtgccaggagaacggccaagaattatccccaatagctctggaacctgggcctgagccacaccgggctaagcaagaagccagaaaccaaaaaagggcacaagggcgtggtgaggtcggagctggcgcagggccaggcgctcaagctggcccaagcgccaagagggccgttcatctatgccgcggacctgaaggggacggcagtcgagacgatcctggtcccaggggggatgcacccccattcgtggccgacccggcaacccaagtagaagcagatgaacagctgtgtattcctcccctcaattcgcaaacatgcctgctgggctcagaagagaatttagccccactggccggagaaaaggccgtgcccccagggaacgatccagtgtcccccgcaatggtgcgctcccgtaatccaggaaaagacgactgtgccaaagaggaaatggccgtggctgccgatgcggctacccttgtcgacgaaccagaaagcatggtgaacctagcatttgtgaaaaacgactcgtatgagaaaggcccagatagcgtcgtggtccatgtgtacgttaaggagatctgccgtgacacatccagggtgcttttccgggaacaagacttcacattgatcttccaaacacgcgatgggaacttccttaggcttcaccccggttgtggacctcataccacctttagatggcaggtaaaattgagaaaccttatcgagcccgaacagtgcacgttctgcttcaccgcctctaggattgatatctgtctccgaaaacggcaaagccagcgatgggggggactcgaggccccagccgcacgtgttggcggtgctaaggtcgcagtgcccaccgggcctacgccgttagattctaccccccctggaggtgctcctcatcctctcaccgggcaagaggaggcacgcgcagtggagaaggataaatccaaggccaggtcagaggatactggtctggatagtgtggccacaaggactcccatggaacacgttaccccaaagcccgagacacatctggcatctcccaagccaacatgtatggtacctcccatgccccactctcctgtatcaggggactctgtggaagaagaggaggaagaggaaaaaaaggtctgcttgcccggatttacaggtctcgtaaatctgggcaacacttgcttcatgaacagcgttattcagagcctttccaacactcgcgagctgcgtgatttttttcatgaccgctcgtttgaagccgaaatcaactacaacaaccccttgggaaccggcggacgtctggccatcggtttcgctgtactgttgcgcgctctctggaagggcacacaccatgcctttcagccatccaaactgaaggccatagtggcttctaaggctagtcagttcactggatacgcgcagcatgatgcccaggagttcatggcttttctgcttgacggtctgcacgaggatctgaacagaatccagaataaaccctatacagagacagttgatagcgatggcaggccggacgaagtggtggctgaggaagcttggcagcgccataagatgcgaaatgatagctttatagttgatttgtttcagggtcaatacaaatccaagctggtgtgtcctgtctgcgctaaagtctcaatcacctttgacccttttctctatctgccagtgcctttgcctcagaagcagaaggtgttgcctgttttttattttgcaagagaaccccacagcaaacctattaaatttctggtcagtgtgtcgaaggaaaacagcacggccagcgaagtgcttgattcattgagtcaaagcgtgcacgtcaaacccgagaaccttcgcctcgcagaggtaatcaagaatagattccaccgtgtgtttctgccctcgcatagcctggacacggtgagcccgtccgataccttactctgttttgaactgctgtcctcagaactcgccaaggagcgggtggtggtgctagaggtacagcagcgccctcaggtcccatctgtgcccatctccaagtgtgcggcttgccagcgaaagcagcagagtgaggatgagaagctcaagcgctgcaccagatgttacagggtcggatattgcaatcagctgtgccagaagactcactggccagaccataaaggtctttgccgcccagaaaatataggatatcccttcctggtgtccgtgcctgcctctaggctcacctacgcacgcctggcccagctgctcgaggggtacgccagatactcagtgagtgtgttccaacccccttttcaaccaggacgaatggccctagagagccagagcccaggatgcacaacgttgctctctacaggctccctcgaggccggtgacagcgagcgagaccccatccagcctcctgaactccagctggttacacctatggctgaaggcgataccggactgcctcgcgtgtgggctgctccggatagaggacccgtcccttctacctccggtatcagcagcgagatgctggctagtggccctatagaggtggggtccctgccggcaggcgaaagagtgtctaggccagaagccgcagttcctgggtaccaacacccatcggaagccatgaatgcccatactcctcagtttttcatatacaaaatcgatagttccaacagagaacaacgtctggaggataaaggggacacgcctctagagttaggagacgactgttctcttgctctggtctggagaaataacgaacgcctgcaggaattcgttcttgttgccagcaaagagctggagtgtgcggaggatcctggcagtgccggagaagcagcccgtgctggacactttactctggatcagtgtttgaacctgtttacgcggccagaagtccttgcaccagaggaggcttggtattgccctcagtgtaagcaacacagggaggcgagcaagcagcttctcttatggcgccttcccaacgtgctgatcgttcagttgaaacgcttctccttccggtcctttatttggagggataagatcaatgatctggtggaatttcctgtacgcaacctcgatctctctaaattttgcattgggcagaaagaagaacaattgcctagttacgacctgtatgccgttatcaatcattatggaggcatgattggaggccactatactgcatgcgcacggctgcccaacgacagatcaagtcaaaggtcagatgtcggttggaggttgtttgatgattctacggtgaccacagtggatgagagccaggtggtgacaaggtacgcctacgtactcttttacaggaggcgcaatagccccgtcgaacgacctcctcgcgctgggcatagcgagcaccatccagacctaggtcccgctgccgaggccgctgcatctcaggctagcaggatttggcaggaacttgaagccgaggaggaaccagtccccgaggggtctggacccctcggaccctggggtccccaggactgggttgggccactgcccagaggcccaaccacacctgacgaaggctgcttgaggtacttcgttctgggtacagtggccgctctggtggccctggtcctgaacgtgttctacccactggtcagtcaaagccgatggcggtag

SEQ ID NO: 55707 - DNA, 4119 bp, Artificial Sequence
  Description of Artificial Sequence: Synthetic coding sequence
atgagtggaggggcttctgctacgggtccccgacggggaccacccggtctggaggatactactagcaagaagaagcagaaggatagggccaaccaggaatctaaggacggtgacccacggaaggaaacagggtcgaggtacgttgcccaggccggactcgagcctctggcgagtggggaccctagcgccagcgcgtcacatgcagcaggaatcactggatctcggcacaggacacgactattttttcccagtagtagcggatctgcaagcacgccacaggaagagcagacaaaagaaggggcttgtgaggacccccatgaccttctcgctactccaaccccagagcttctgctcgattggcggcagtctgctgaggaggtaatcgtgaagctgcgcgtgggcgttggcccactccagcttgaggacgtggatgctgccttcactgataccgactgtgttgttcgctttgcaggcggacaacaatgggggggtgtcttctacgccgaaatcaagtccagctgcgccaaggttcagacacggaagggcagtttattgcacctcactctgcctaaaaaaaagaaaccattgggaacacaagagctggtaccagggctgcgctgtcaagaaaacggccaggagcttagtcctatagccctcgagccaggcccagagcctcatagggcaaaacaggaggccagaaatcagaagcgagctcagggacgaggagaggttggggctggagccggtcctggggctcaggccggtccttccgctaaacgggctgtacacctgtgtaggggccctgagggtgatggaagcagagacgatcccggacctcgcggtgatgcaccaccatttgttgctgaccccgctacccaggtggaagccgatgagcagctgtgtattcctcccttaaattctcaaacatgcttactggggagcgaagaaaacctggctcctctggccggtgaaaaggccgtgccgcctggaaacgacccggtgtctcctgcgatggtgagaagccggaatcctgggaaggacgattgtgccaaagaggaaatggccgtcgccgcagacgctgccaccttggtggatgaacccgagagcatggtaaacctcgccttcgtcaagaacgatagctacgagaaggggccagacagtgtggtggtccatgtctatgtgaaggaaatatgtcgcgatacctcccgggtcctgtttcgggagcaggattttaccttgatttttcagactcgcgacgggaacttcctgcgattgcaccctgggtgcggccctcatacgaccttcagatggcaggttaagttgaggaatctgatcgagcccgaacaatgcaccttctgcttcaccgcatcgaggatcgacatatgcctccggaagcgccagtctcagcgatgggggggtctggaagccccagccgcacgcgtggggggtgctaaggtagcagttcctaccggccctaccccgctggattctacaccacccggtggtgcacctcacccactcacaggacaggaagaagccagagctgtggagaaagataaaagcaaagccaggtccgaggacaccggcctggactccgttgctacgagaaccccaatggagcacgtcacacctaagcctgaaactcacctggctagtcctaaaccaacatgtatggttcccccaatgcctcacagccctgtctccggcgatagtgtggaggaggaggaagaagaggagaagaaggtgtgcctgccgggtttcacaggcctggtaaatctggggaacacctgctttatgaactccgttatccagtctctgtccaacacgcgcgagcttagggatttctttcatgatcggagttttgaggccgaaatcaactacaataatcctctgggtacgggaggcagattagccataggcttcgctgtcctcctgcgggcactttggaaagggacacaccacgcatttcagccttcaaagcttaaggctattgtcgctagcaaagcatctcagtttaccggatacgctcaacacgacgcacaggaattcatggcctttctgcttgatggtctgcacgaggatctgaatcggattcaaaacaaaccatataccgaaacagtagactcagacggtcggccagatgaggtggttgcagaggaggcctggcagagacacaagatgaggaacgattcttttatcgtggacctgttccaaggccagtacaaatccaagctcgtttgtcctgtatgtgctaaggtgtcaattacttttgaccctttcctttatcttccagtccctctgcctcagaagcaaaaggttctgccagtgttttacttcgctcgggagccacactctaagcctatcaagttcctagtatcggtctctaaagaaaattccactgcctctgaagtcctggattcgctgtcccagtctgttcacgtaaagccagagaaccttagactggcagaagttataaaaaaccgcttccaccgtgtcttcctgccttctcattccctggataccgtgtcgccgagcgatactctactgtgcttcgaattgctgagcagcgagctcgctaaggagcgcgtggtggttctggaggtgcaacagcgacctcaggtaccaagtgtgcccatcagcaagtgtgcagcatgtcagcgcaaacaacagtcagaagacgaaaaacttaaacggtgtactcgatgttatcgcgtgggttattgcaatcagttgtgtcagaaaacccactggccagaccacaaaggactgtgtcgccctgagaacattggctatccctttttggtttccgtgcctgccagccggctgacctacgcacgactggcccaacttctcgagggatacgctagatattcagtgagtgtttttcaacccccattccagcccggacgcatggctctggagtcacagagccctggctgtaccactctgctttccaccggtagcctagaggccggagactctgagcgtgaccctatacagcccccagaactccagctggtaaccccaatggctgaaggcgacaccggcttgcccagagtgtgggcggctcccgacaggggccctgttccgtcaacttccgggatttcttccgaaatgctggcctccggtccaatcgaagtgggcagcctccccgctggcgaacgagtaagccgtcccgaggcagcagtgcctggatatcagcacccctcggaggcaatgaatgcacacaccccccagttctttatctacaagatcgattcctctaatagggaacaacggcttgaagacaaaggagacaccccccttgaactgggggacgattgtagcctggccttggtgtggagaaacaatgagcgcttacaggaatttgtactggtggcatctaaggaattagagtgcgccgaggatcccggatctgccggagaagctgccagagctggccatttcacactggaccagtgtctgaatctgtttacacgtcctgaagtgttggctcctgaagaggcttggtactgtcctcagtgtaaacagcacagagaggccagtaagcagttgttgctgtggcgcctgccaaacgttctgattgtccagctcaaaagattttcctttcggtctttcatatggagagacaagataaacgatctcgtggaattccctgtccgcaacctggatctcagcaagttttgcataggacagaaggaagaacagctgccttcctacgatctgtacgcggtcattaatcactacggaggtatgatcggtggacattacacggcatgtgctaggctgcctaacgaccgctcttcccagaggtccgatgttggatggcgcctgtttgacgacagtacagtcacaacggtcgacgagtctcaggtagtaacaaggtacgcttatgtcctgttctacagaaggagaaatagcccagtggagcgccctccacgtgctggtcacagtgaacatcaccctgacttgggacccgctgctgaggcagctgcgagccagggtctgggaccaggacaggcaccagaagttgcaccaactcgtaccgctccagaaaggttcgctccaccagtggatcggccagctcctacatactctaatatggaggaggtggactag

SEQ ID NO: 55708 - DNA, 3357 bp, Artificial Sequence
  Description of Artificial Sequence: Synthetic coding sequence
atgcccgcagttgcgtccgtacctaaagagctctatttgtcttcaagcctgaaggatctgaataagaaaaccgaggtgaaaccagagaagatttctactaaaagctacgtgcactccgctctgaagatcttcaagacagctgaggaatgccgtctggaccgggacgaggaacgcgcttatgttctctacatgaaatacgtgacagtttacaacctgatcaaaaagagacctgacttcaagcagcagcaggactatttccatagtattttaggccctggtaacatcaaaaaagctgtagaagaggccgaacgcctgagtgaatcactcaagctcagatacgaggaggccgaggtgcggaagaagctggaggaaaaagaccggcaggaagaagcacagaggttgcagcagaaaagacaagagacaggcagggaggatggcggaactcttgccaaaggatctttggagaacgtactggatagtaaagacaaaacacagaaatcaaacggcgaaaaaaatgagaaatgtgaaacaaaggaaaagggagccattacagccaaggagctatacacaatgatgactgataagaacatcagcctcataattatggacgccaggcggatgcaggactatcaagactcctgtatattgcactcactttctgtgcccgaggaggccatatcccctggcgtgaccgcatcatggatcgaagcccaccttccagacgattcgaaagacacgtggaaaaagcggggtaatgtggaatacgttgtgctccttgattggttctcatcagcaaaggatctgcagatcggaaccacactcaggtccctaaaagacgccttgtttaagtgggagagcaaaacggtactgcgcaatgagccattagtattagagggtggttatgaaaattggctgctgtgctatccacagtatactaccaatgccaaagttactccacctccaagacgccagaatgaagaggttagcatcagtctggacttcacttatccaagtttagaagaaagcatcccaagcaagcctgccgctcagacccctccggcttctattgaggtcgacgagaacattgagctgatctcaggccagaacgaacggatgggcccacttaacattagcacccccgtggagccagtcgccgctagcaagtctgacgtgtccccaatcatacagcccgtgcccagcatcaagaacgtcccgcagatcgataggacaaagaagcctgccgtgaagctccccgaggagcaccggatcaaatccgagagtaccaatcatgaacaacagtccccacagagcgggaaggttattcctgatcggtccaccaagcctgtcgtgttctccccaacactcatgctgacggacgaggaaaaggctcggattcatgctgagacggccctgctcatggaaaaaaataaacaagagaaggaactcagagaaagacagcaggaagaacagaaggagaaactgagaaaagaggagcaggagcaaaaggccaaaaagaaacaggaggccgaagagaatgaaattactgaaaagcagcagaaagcaaaggaggagatggaaaaaaaagagtccgaacaggccaagaaagaggacaaagaaacaagcgcaaagaggggcaaggagataacgggagtcaaaaggcagagtaaatcagagcatgagacaagcgatgccaagaagtcggtagaggaccgcggtaagcgctgcccaacccctgaaatccagaagaagagcacaggcgacgtgcctcatacttctgttactggggactccggctccggaaaaccgtttaaaatcaaagggcagccagaaagtggtattttgaggactgggaccttccgggaggataccgatgacaccgagaggaataaagcacagcgggagcctctcactcgtgcacggagcgaagaaatggggagaattgtccctggtctccctagtggatgggctaagttcttagatccgattaccgggactttccgctactatcatagtccaacaaatactgtgcatatgtacccacccgaaatggcaccaagttctgccccaccatctacccccccaacccataaggctaagccccagatacccgctgagagagacagagaaccaagtaagctcaagagatcgtattcctctcctgacatcactcaggcaattcaggaggaggagaagcgcaaacctactgtgacccccacggttaaccgagaaaacaaacccacctgctatcctaaagctgaaatctcccgcctatccgcctcccaaattagaaatctgaaccctgtgttcggtggatcggggccagccctcaccggcttgcgaaacctggggaatacctgttacatgaattcgattctgcagtgtctctgtaatgcgcctcacctagcagactactttaataggaattgttatcaggacgacatcaacaggtcaaatttgctggggcataagggtgaggtcgccgaggaatttggtattatcatgaaggctctctggacaggtcagtatcgctatatatccccaaaagatttcaaaatcacgataggaaaaataaatgaccagtttgccggatattctcaacaagactcccaggaactccttctgttcctgatggacgggctacatgaggatctaaataaggccgacaaccgaaaacgctacaaggaggagaacaacgaccatctggacgacttcaaggccgctgaacatgcttggcaaaaacataagcagctcaacgagagcatcatcgtggcactgttccagggtcaattcaaaagtaccgtccagtgcctcacctgtcataagaaatccagaaccttcgaggcttttatgtatttgagtctgcccctggctagcacctccaagtgtactttacaagactgcctgaggctcttttcgaaggaagagaaactgactgacaacaatcggttctattgttcccactgtcgtgccagacgagattctttgaagaagattgaaatatggaaactgccgcctgtcctcctagtacatctcaagagattctcctacgatggacggtggaagcagaagctgcagactagcgtcgatttcccactagagaacctcgacctgagccaatacgtcatcgggcctaaaaataatctcaagaaatacaacctgttttcagtgagcaaccattacggaggattagacggcggacattacaccgcctattgcaaaaacgctgcaagacagcgatggtttaagttcgacgaccacgaggtttccgatatttccgtgagctcggtgaaatcctcagctgcctacatcctgttttacacatcattggggccacgcgtgactgacgtcgccacatag

SEQ ID NO: 55709 - DNA, 996 bp, Artificial Sequence
  Description of Artificial Sequence: Synthetic coding sequence
ctgactgggctgcgaaatttgggcaacacgtgttacatgaattctattctccagtgcctctgcaacgcaccccacttggccgattactttctcaccgggaagtacatgagcaacctcttaggacacaagggcgaagtcgcggaagaattcgggattattatgaaagccctctggaccgggcagtacagatatatctctccaaaggacttcaagatcacgattgggaaaatcaacgaccagtttgctggatacagtcagcaggatagccaagagttgctgctctttctgatggatggactgcacgaagatttgaataaattccaggctgacaataggaaaagatacaaggaagaaactgccgagcatgcttggcaaaaacataagcagctgaacgaatccattattgtggccctgtttcagggacaatttaaatcaacagttcaatgtcttacatgccacaaaaagtcccgtactttcgaggccttcatgtatctgtctctccctttggcctccactagtaagtgtaccctgcaagactgcctgaggctgttctctaaagaggagaagctgactgataacaatcgtttttattgcagccattgtcgtgcacggcgagattccctgaaaaagatcgagatttggaagctcccacctgtcctgctggtgcacctgaaaaggttctcttacgacggtcgttggaaacaaaaactgcagacaagcgtggattttcctctggaaaatctcgacctgtcacaatatgtaatagggccaaagaacaacctgaagaaatacaacctattttccgtctccaaccactatgggggactagacgggggtcattataccgcctactgtaagaacgccgctcgccaacgctggtttaagttcgacgatcatgaggtatctgatatttccgtctcatccgtgaaatcctccgctgcgtacattctcttttatacctctttaggccctcgcgtaacagacgtcgccacctag

SEQ ID NO: 55710 - DNA, 3357 bp, Artificial Sequence
  Description of Artificial Sequence: Synthetic coding sequence
atgcccgcagtggcctccgtcccaaaggagctgtacctttcaagcagtctgaaggacctgaataaaaagactgaggttaagcccgagaaaattagtacaaagtcatacgtacattccgcgctgaagatcttcaagaccgctgaggaatgtcgtttggatcgggacgaagagcgggcatacgtcctatacatgaaatatgtgacagtttacaacctcattaagaaaagacccgactttaaacaacagcaggattattttcacagcatccttggtcctggaaatatcaagaaggcggtcgaggaggctgagcggctgagtgaaagcctgaagctgcgttatgaggaggcagaggtccgtaagaaacttgaagaaaaggaccggcaagaggaggctcagcgtttacagcagaagcgtcaggagaccggccgtgaggatgggggtactctagcaaagggttccctggaaaacgtcctcgacagcaaagataagactcagaaatccaatggcgagaaaaatgaaaagtgtgagacaaaggagaagggagcaatcaccgcgaaggagctatacacaatgatgacggataaaaatatttccctgatcattatggatgctagaaggatgcaagattatcaggactcgtgtattctccattctctttcagtgccggaagaggctatctctccgggagtgacagctagttggatcgaagcacatctgcccgatgacagtaaagatacttggaagaagagggggaacgtggagtatgtcgtcttgcttgattggttttccagcgccaaggatctgcagattgggaccaccctgaggagcctgaaggacgccctgttcaagtgggagtcaaagacagtgctgaggaacgaaccattggtactggagggcggatatgaaaactggctgctctgttatcctcagtatacgacaaatgcaaaggtcacccctcctcccagacggcaaaacgaggaagtgagtatttcactggacttcacatatccaagccttgaagaatccattcctagtaaaccagccgcacagacccctcctgctagcatcgaggtcgatgaaaatattgagctgatcagtgggcagaacgagcgaatgggcccactgaacatctcgactccggtggaacccgtggccgcttcaaaaagtgacgtatcacctataatccagcctgtgccgagtattaagaacgttcctcagatagataggaccaagaagccagctgtaaagctgccagaggaacaccggatcaagagtgaaagtaccaatcatgagcagcagtcccctcaatccgggaaggtcatccccgatagaagcactaagccggtggtgttcagtcctaccttaatgctcactgacgaggaaaaggcacggatacatgccgagaccgcgctactgatggaaaaaaacaagcaggagaaagagctcagagaaaggcagcaggaggaacaaaaagaaaaattaaggaaggaagagcaagaacagaaggcaaaaaaaaaacaggaagcagaggagaacgaaatcaccgaaaagcagcaaaaggcaaaggaagagatggaaaagaaggagagtgaacaggcaaagaaagaagacaaggaaacgagtgctaaaaggggcaaagagattactggtgtgaagcggcagtcgaagtcagaacatgaaacatccgatgctaaaaaatctgtggaagacaggggaaaacgttgcccgactcccgaaatccagaaaaaatccacgggcgacgtgcctcatacatccgtgaccggcgatagtggatcagggaagccattcaagattaagggccaacctgagtctggtatcttgcgtacgggtactttccgggaggatactgatgataccgagcgtaacaaagcacagcgggaacctctcaccagagccaggtcagaagagatggggagaatcgtcccagggttgcctagcgggtgggcaaaatttctcgatccaatcactgggacattccgctattatcatagtcccactaatacagtccacatgtatccgccagaaatggccccatcttccgcccctccttcaaccccccctacccataaagccaagccacagatacctgccgaaagagaccgagaacccagtaagctgaagcgttcctatagctctcctgatattacacaggcaatccaggaggaagaaaaacgcaagcccaccgtcacgccaactgtgaatcgagagaataagccgacgtgctatcctaaagccgaaataagcaggttgtcagccagccaaataagaaatcttaaccctgtgttcggaggctctggacccgcacttaccggcctgaggaatttggggaacacttgttatatgaactctattctgcagtgcttgtgcaacgcaccccaccttgcagactacttcaatcgcaattgttatcaagatgatattaaccgcagcaacttgctcgggcataaaggtgaggtcgcagaggagtttggcattatcatgaaggctctgtggaccggtcagtatcgctacatttcgccaaaggatttcaaaattaccatcggcaaaatcaatgatcagtttgctggctattcccagcaggacagtcaggaactgctgctatttctgatggacggcctccatgaagatctgaataaggccgacaataggaagcgttacaaagaggagaataacgaccaccttgacgattttaaagccgcagagcatgcctggcagaaacataagcagcttaatgagagtatcatcgtcgcactgtttcagggtcagtttaaaagcacagtacagtgcctcacatgccacaaaaagtctcgcacgtttgaggctttcatgtacctgagcctgcccctagcctcaacctccaagtgtacgctccaagactgcctaaggctcttcagtaaagaagagaaattgactgataacaacagattttactgcagccactgtagggcgaggcgcgactctctcaagaagattgaaatctggaaattgcctcccgttctgctcgtccatctgaagcgtttttcttacgacgggagatggaaacagaagctccagactagcgtggatttccctctggagaatctcgatttgtcccagtatgtgataggacccaagaataacctgaagaagtacaacctttttagtgtaagtaatcactacggcggtcttgatggtggacattacactgcttactgtaagaatgcagcaagacaaaggtggtttaagttcgacgaccatgaagtgagcgacatctcggtatcatcggtgaaaagttcagcggcatacatcctgttttacacctccctgggcccaagagtgaccgatgtggcgacctag

SEQ ID NO: 55711 - DNA, 3357 bp, Artificial Sequence
  Description of Artificial Sequence: Synthetic coding sequence
atgcccgctgttgcttctgtgccaaaggaactttacctctcatcgtcgctgaaggatctgaataaaaagacagaggtgaaacctgagaaaatcagtactaaatcatatgttcactccgctttgaagattttcaagactgctgaggaatgccggctggacagagacgaggagcgggcatatgtgctgtatatgaaatatgtcacagtctacaacctgataaaaaagcgccctgactttaaacaacaacaggactattttcatagcatcttgggccctggcaacatcaagaaggcagtggaggaggccgaaagactctcagaatccctgaaattgcggtatgaagaggctgaggttcgaaagaaattggaggaaaaagatagacaggaggaagcacagagactgcagcaaaaacgccaggaaaccggcagagaggacggagggaccctagccaaaggatctctggagaacgtcctcgactcaaaagacaaaacacagaagtccaacggagagaagaacgagaagtgtgagaccaaggagaaaggcgctatcacggctaaggagctttacaccatgatgacagataaaaatatttccctgatcataatggacgctagacgcatgcaggactatcaggattcctgcattctgcatagtctttccgttccagaagaggccatctccccaggggtcactgccagttggattgaagcccaccttccagatgacagcaaggatacatggaaaaaaagagggaatgtggaatatgttgtattactggactggttcagttctgccaaggatctccagatagggaccaccctgaggtcacttaaggatgccctgttcaagtgggaaagcaaaactgtactgcggaatgaacctctggtgctcgaagggggatacgagaattggctgctgtgttacccccagtacacaactaatgcaaaagttaccccaccgcctaggcgtcagaacgaggaggtaagcattagtttagactttacttatcccagcctggaggagtcaattccttccaaacctgcagcacagacacccccagcgtccatcgaggttgacgagaatattgagctgatatcaggccagaatgagagaatgggccctctgaatatttcaacccccgtggagccagtggccgcttctaagtctgatgtcagccccataatccaacctgtgcccagcattaaaaatgtcccacagatagatagaacgaaaaaaccggcagtgaaactgccagaagagcatcgtatcaaatcggaaagcaccaatcacgagcaacaatcaccgcaatcgggcaaagtgatccctgaccgctcaacaaagcccgttgttttcagccccactctaatgctgacggacgaagagaaggcgagaatccatgctgagacagcactgctgatggagaaaaacaagcaagagaaagagctgcgggagagacagcaggaagagcagaaagaaaaactcagaaaagaagaacaggaacagaaagccaagaagaaacaagaggctgaagagaacgagatcaccgagaaacagcagaaagccaaggaggaaatggaaaaaaaagagagcgagcaggccaagaaagaggataaggaaacaagtgcaaagcgtgggaaggagatcaccggcgtcaaacgccagagcaaatccgaacacgagacctcagacgcgaaaaagtccgtcgaagatcgcggtaagcgttgccctacacccgagatccagaagaagtctacaggtgacgttccccacactagcgtcaccggcgacagtggcagcgggaagcccttcaagattaagggtcagccagaaagcggaatcctgagaacaggaaccttcagagaggacacggacgataccgagagaaataaagcccaacgggaacctttgactcgggcacgtagtgaagagatgggacgaattgtacctgggcttccctccggctgggctaagttcctggatcctatcactggcacattccggtattaccactcacccacaaacactgtgcacatgtaccctcctgagatggcaccaagtagcgcgccaccctctacacctcccacacataaggcaaagccacagatcccagcggaacgagatagagagccttctaagctgaagaggtcctactcctcccctgatattacacaggcaattcaagaggaagagaagcggaaacccaccgtgacgcctacggtgaatagggaaaacaaaccaacctgttatcccaaggctgagatcagcaggttatctgcttcccagatcaggaacctgaacccagtgttcggaggcagcggccctgccctcaccggacttcgaaatctcggcaacacatgttatatgaactctattctgcagtgtctgtgcaacgcacctcacctcgctgactacttcaaccggaattgttaccaggatgacattaatagaagtaacttactgggtcacaagggggaggtggccgaagagttcggaatcatcatgaaggccttatggactgggcagtacaggtacatctctcccaaggactttaaaatcaccataggcaaaattaatgaccagttcgctggatatagccagcaagatagccaggagcttctacttttcctcatggacggtctccacgaggatctgaacaaagctgacaatcgtaagcggtataaagaagaaaataacgaccacttggatgatttcaaggccgcagaacatgcttggcaaaaacataagcagctcaacgagtcaataatagttgcactattccagggccagttcaaatctaccgtgcagtgtctcacatgccacaaaaaatcacggacattcgaggccttcatgtatctcagtcttccccttgcctcaacttccaagtgcacgctgcaggactgcctgagactctttagcaaagaggagaagcttacagataataatcgcttctactgcagccactgtcgcgcaaggcgggatagtcttaaaaagatcgagatttggaaactgccaccggtcctgctcgtgcacctgaaacggttttcctacgacggccgatggaagcagaagctgcaaacgagcgtcgacttcccgctggaaaaccttgacctatcacagtacgtgattgggccaaagaataacttgaagaagtacaatctcttttccgtatctaatcattatggcggacttgacggcggacactataccgcttactgcaaaaatgccgcaaggcaacggtggtttaagttcgatgaccatgaggtctcagacatcagtgtctcctccgtgaagagttctgccgcttatattcttttttacactagcctgggccctcgggttacagacgtcgccacttag

SEQ ID NO: 55712 - DNA, 408 bp, Artificial Sequence
  Description of Artificial Sequence: Synthetic coding sequence
atgcctgccgtcgcgtctgtgcctaaggagttatatctatccagttctctcaaggatttgaataaaaaaaccgaggtcaaacccgagaagataagtaccaagtcttatgtgcactctgctctaaaaattttcaaaacagctgaggagtgtcgcttggaccgagacgaagagcgggcttacgtgctatacatgaaatatgtgacagtgtacaatcttatcaaaaaaaggcctgatttcaagcagcagcaggactacttccattcgatcctgggccctgggaatattaagaaggctgttgaggaggccgagcgccttagcgaaagtctcaagctacggtatgaagaagccgaggtccgaaagaaattagaggaaaaagatcgccaggaggaggctcaaagactccagtag

SEQ ID NO: 55713 - DNA, 291 bp, Artificial Sequence
  Description of Artificial Sequence: Synthetic coding sequence
atgcccgcagtggcgagtgtgcccaaagaactgtatctttcctcgtcactgaaagacctgaacaagaaaaccgaggtcaagcccgaaaaaattagcactaagtcctatgtccatagcgccctgaagattttcaagactgcggaggagtgtcgtcttgaccgtgacgaggaaagagcctacgttctgtacatgaagtacgtgacagtctacaacctgattaagaagcgtccagattttaagcagcagcaggattactttcactctatcctcggacccggtaatatcaaatag

SEQ ID NO: 55714 - DNA, 222 bp, Artificial Sequence
  Description of Artificial Sequence: Synthetic coding sequence
atgcccgctgtggcgagcgtacctaaggaactgtatctgagcagctcgctcaaggatttgaacaagaagaccgaggtgaaacctgaaaaaattagcaccaagagttatgtacactccgcattaaagatattcaagacagcggaagagtgtaggctggaccgcgacgaagagcgggcatatgttctgtacatgaagtacgtgacagtgtacaatctgatttag

SEQ ID NO: 55715 - DNA, 132 bp, Artificial Sequence
  Description of Artificial Sequence: Synthetic coding sequence
atgtcttccaccagtagcaaaagggcacccacgaccgcaacacagcggttaaaacaggactacctgcgtatcaaaaaagatcccgtgccttacatctgcgccgagcccctgcctagcaatattcttgagtag

SEQ ID NO: 55716 - DNA, 957 bp, Artificial Sequence
  Description of Artificial Sequence: Synthetic coding sequence
atggaaaccagatacaatctgaagagccctgcagttaaacggctgatgaaggaagccgctgagctgaaggatccgacagatcactatcatgcacaacctttagaggacaatctattcgagtggcactttacggtccgcggaccgcctgattccgactttgatggtggcgtctatcacggccgaatcgtgttacccccagaatatcctatgaaacccccaagtattatattgttgacagcaaatggccgatttgaggtcggcaagaagatttgtctgtcaatcagcggccatcatcccgagacatggcagcctagctggtctataagaaccgcactgcttgctataattggcttcatgccgaccaagggtgaaggcgcaatcggtagcctggactacacaccagaagaaaggcgggctctggctaagaagagtcaggacttctgctgcgagggctgtgggagtgcaatgaaagacgtactgttgcctctcaaatctggaagcgactcttcccaagcagaccaagaggccaaggaactggcgaggcagatctctttcaaggcagaggtgaacagctcaggcaagactattagtgagtcagatttgaatcatagttttagtctgacggacctacaggatgacattcccacgactttccagggcgcaacagcaagcacctcatatggcctgcagaattcatccgctgcatcctttcaccagcccacgcagcccgtcgctaaaaacacaagcatgagtccccgtcaacggagagcacagcagcagtcacagaggaggctaagtacttctccagacgtgattcagggtcaccagccccgagacaatcacaccgatcatgggggttcagcagtgctgattgtgatcttgacacttgccctcgctgcactgatatttaggcgcatctatctcgctaatgaatatattttcgacttcgagttatag

SEQ ID NO: 55717 - DNA, 912 bp, Artificial Sequence
  Description of Artificial Sequence: Synthetic coding sequence
atgaaagaagccgctgagcttaaggatcctactgaccattaccatgcccagcctttggaggacaatctgtttgagtggcactttacggtgaggggaccgccagactctgatttcgacggtggagtttaccacgggaggatcgtattgccccctgaatacccaatgaagcccccttccataatcttgttaactgccaatggcagatttgaagtagggaagaagatctgtttgtctataagcgggcaccacccggaaacatggcagccgagttggtccatccgcaccgccctcctagcgattatcggttttatgcccacgaagggcgaaggtgctattggctccttggattacacccctgaggagcggagagccctcgcgaagaagagccaagatttctgctgcgagggctgtgggtctgctatgaaggatgtgcttcttccgctgaagagcgggtcagatagctctcaggccgaccaggaagccaaagaactcgcccgtcagataagcttcaaggccgaggttaacagcagcgggaagacaatctctgaaagtgatttgaaccattcgttttcattaacggacttacaagatgacatcccaacaactttccagggtgccaccgccagcacctcctacggcttacaaaattcttcagccgcaagcttccatcagccaacccagcccgtcgcaaagaacacctctatgagccctaggcagaggcgcgctcaacagcagtctcagagacgcctctctacctcacctgatgtgatacagggacatcaacctcgcgataaccataccgatcacggcggttctgcagtgttgatagtgattctcactctggcccttgcagctctgatcttcaggagaatatacctagctaacgaatatatcttcgacttcgagctgtag

SEQ ID NO: 55718 - DNA, 675 bp, Artificial Sequence
  Description of Artificial Sequence: Synthetic coding sequence
atgtggccgcaggatatcgccggacggcattacgtagtccgtggccctgaaatgactccctacgagggcggttattaccacggcaaactgatcttccctagggaattcccattcaagcctcctagcatctatatgatcactcccaacggcaggtttaagtgtaacacacgactctgcctgtctattaccgacttccatccagacacttggaatcccgcatggtctgttagtacaatcctgaccggcctgctgagctttatggtggaaaagggccctactctcggctcgattgagacaagcgattttaccaaaagacaacttgccgtgcagagcctggccttcaacctcaaggacaaggtgttctgtgagctcttcccggaggtggttgaagagatcaaacagaaacagaaggcccaagatgagctaagtagtagaccacagaccttacccctcccagatgtagtaccggacggagaaacccatctcgtccagaacgggatccagcttctcaatggacacgcaccaggggcagtgcccaatctagcagggctgcagcaggccaatcggcaccacggtctactgggcggtgctctggcgaacctttttgtcattgttggcttcgccgcattcgcctatacagtcaagtacgtgctgcgatcaattgcccaagagtag

SEQ ID NO: 55719 - DNA, 624 bp, Artificial Sequence
  Description of Artificial Sequence: Synthetic coding sequence
atgaccccctacgagggcggttactatcacggaaagctcatctttccccgagaatttcccttcaagcccccttcgatctatatgataactccaaatggtagatttaagtgcaacaccagactgtgcctgtccattaccgattttcatcctgatacatggaaccccgcatggtctgttagcacaatcttgactgggctgttatcattcatggtcgagaaaggcccaacactcggaagcatcgagacctctgatttcacaaaaagacagcttgccgttcagtctttggcttttaatttaaaggacaaagttttttgcgagctgtttcctgaagtagtggaagagataaaacagaagcagaaagctcaggacgagcttagcagcagacctcagactctgcccctgcccgacgttgttcccgacggcgagacccaccttgttcagaacggaattcagctgttaaacgggcacgctccaggggcagttcccaatctagcaggcctacagcaagctaatcgccatcacggccttctggggggtgctctggccaacttatttgtaattgtgggcttcgcagcttttgcctacacagtcaagtacgtccttcgatcaatcgcgcaggagtag

SEQ ID NO: 55720 - DNA, 624 bp, Artificial Sequence
  Description of Artificial Sequence: Synthetic coding sequence
atgaccccttacgaaggcggatattaccacggaaaactgatatttcctagagaattcccctttaagccacctagcatctacatgattacacctaacggcagatttaaatgtaatacacgactgtgcctgtctatcacagactttcacccggatacctggaatccagcttggtctgtctctacaatactgactggcctgctctcttttatggttgaaaaaggacccaccctcggctccattgagacctcagacttcacaaagcgacagttagcagtgcagtccttggcattcaatctgaaggataaagttttttgtgaactgtttccagaagtcgtcgaggaaatcaagcagaaacagaaggcacaggacgaactgtcttcccgaccacagacgttacctcttcccgacgttgtgcccgatggcgaaacccatctcgtgcaaaacggaatccagttgcttaatggccacgctccaggtgccgtgcccaacctagccggactgcagcaggcaaataggcaccacggtctgttaggcggagctcttgccaatcttttcgtgatcgtgggattcgccgcttttgcttacacagtgaagtatgtcctgagatccatcgcccaagagtag

SEQ ID NO: 55721 - DNA, 780 bp, Artificial Sequence
  Description of Artificial Sequence: Synthetic coding sequence
atgagttctaccagttccaagcgggcacctacaactgcgacgcagaggttgaagcaggactatttgaggatcaagaaggacccggtgccctatatctgtgcagaaccccttcccagcaacattttggagtggcactacgtcgtccgtggaccagagatgacaccttacgagggagggtactatcacgggaagttgatatttcccagagaattcccattcaagcctcccagtatatatatgattaccccaaacggacgttttaagtgcaatacccgtctctgcctctccattacagatttccatccggacacatggaatccagcatggtctgtcagtaccatcctgaccggcttattaagctttatggtggaaaaaggccctaccctgggcagcatcgaaacgagcgatttcaccaaaaggcagctcgcggtgcagagcttggcttttaatttaaaagacaaggtgttctgcgaactgttcccagaagttgtggaagaaataaaacagaaacagaaagcacaagatgagctatcttcgagacctcaaactcttcctctgcccgacgtggttccggatggagagacacacttggtgcagaacggtatacagctgctcaacggccatgctccgggagcagtgccaaacctggctgggttacaacaggctaacaggcatcacgggcttctgggcggtgctctggccaatctgtttgtgatcgtgggcttcgctgcattcgcctacaccgtcaagtacgtattgcgctctatcgcacaagaatag

SEQ ID NO: 55722 - DNA, 780 bp, Artificial Sequence
  Description of Artificial Sequence: Synthetic coding sequence
atgagcagcacatcttcgaaaagagctccaactacagcaacccagcggttgaaacaggactacttgcgcattaagaaggatcctgtgccatacatctgtgccgaacctctaccgtccaatattttagaatggcactacgtagttagaggaccagaaatgaccccgtatgagggcggatactaccatggcaagctaattttcccacgcgaattcccctttaaacctccgtctatatatatgattaccccaaatgggcgatttaagtgcaacaccaggctatgtctctctatcaccgactttcacccagatacatggaatccagcatggagcgtgtccaccattctgacggggctcttgagtttcatggtggaaaaaggtccaacactggggtctatcgaaacgtccgactttacgaaacgacagctcgcagtccagtctttggcattcaacctcaaggacaaggtcttctgtgaactttttcccgaggtcgttgaggagataaaacagaagcagaaggcccaggacgaactttcgtcgagaccacaaacccttccactgcctgatgtggttcccgacggggaaactcatctggttcagaacgggatccagctcctaaatggccacgccccaggtgccgttcctaacctggccggattgcagcaggctaaccgacaccacgggctgttgggcggagccctagctaatttgtttgtaattgtgggcttcgcagctttcgcttatactgtgaagtacgtgctgaggtctatcgctcaagagtag

SEQ ID NO: 55723 - DNA, 624 bp, Artificial Sequence
  Description of Artificial Sequence: Synthetic coding sequence
atgaccccttatgaggggggatattatcacggtaagttaatcttcccacgggaatttcccttcaagccgcctagcatctatatgatcacacctaatgggagattcaagtgtaacacccgtctgtgtctctctatcacggatttccacccggacacctggaatcccgcatggagcgtctctacaattctgactgggttgctctctttcatggtggagaaggggcctacgctgggatcaatcgaaacttcagactttactaaaagacagttggcggtgcagtcactggccttcaatttgaaagacaaggtcttctgtgaattattcccagaagttgtggaggaaataaagcagaagcagaaggctcaagacgagttgagcagtaggcctcaaaccttacccctgcccgatgtggtgcctgatggcgaaacccacctggtgcaaaacgggatccaacttttgaatggccatgctcctggcgctgtcccaaatttagctggcctgcagcaggctaaccgccaccatggactactgggcggagcattggccaacctgtttgtgattgtcgggttcgcagcctttgcgtatacagtgaagtatgtgctgcgcagtatcgcccaagagtag

SEQ ID NO: 55724 - DNA, 828 bp, Artificial Sequence
  Description of Artificial Sequence: Synthetic coding sequence
atgagctcaacctcgtcaaagcgagctcctacaacagcgacacagcgccttaagcaagactatctgcggatcaagaaggatcccgtcccttacatctgcgctgaacctctcccatcaaacattctggaatggtttaagagatttagctggctgtcacttctctcttcctgggattacagacattacgtcgttcgcggtccagagatgactccatatgaaggtgggtactaccacggaaaactgatcttccccagggaattcccattcaagccacctagcatctatatgataacaccaaacgggagatttaaatgcaatacccgtctgtgtctgagcattactgattttcacccagatacctggaatccagcctggagcgtctccaccatcttgacaggcctgctgtccttcatggtcgagaagggccctaccctcggaagcattgaaacatccgatttcaccaaaagacagctggccgtgcaaagccttgccttcaacctgaaagataaggtcttctgcgaactcttccccgaggtggtagaagagatcaaacagaagcagaaggcccaggatgagctgtctagtcggcctcaaaccctcccactccccgatgtcgtgccggatggagaaacacacctcgtgcagaatggtattcaacttctgaacggtcatgccccaggagccgtacctaacttggctggattgcagcaggctaaccggcatcacggcctcttgggcggtgctctcgccaacttattcgtgatagttggtttcgccgcattcgcttataccgtaaagtatgtccttcggtccattgcccaggagtag

SEQ ID NO: 55725 - DNA, 306 bp, Artificial Sequence
  Description of Artificial Sequence: Synthetic coding sequence
atgtcttcaaccagctccaaaagggcgccaacaacggctacgcagagattgaagcaagattatctcagaatcaagaaggaccccgtgccctatatctgcgccgaaccgctccccagtaatattctggaatggttcaaacggttttcctggctgagcctgctgtcatcgtgggattacagacattacgttgttagaggtcccgagatgacgccttatgaaggcggatattaccacgggaaattgatttttccacgggaattcccctttaagcctccttcgatctacatgattacaccaaacggatag

SEQ ID NO: 55726 - DNA, 591 bp, Artificial Sequence
  Description of Artificial Sequence: Synthetic coding sequence
atgtcctctaccagttcaaaacgggctcccaccacagccacccagaggctcaagcaggattaccttagaattaagaaagacccagtgccctatatctgcgccgaacccctgccgtcgaatatccttgagtggcactatgttgtcaggggtccggaaatgacaccctatgagggaggctattaccacggaaagctgatattcccacgtgaattccctttcaagcccccttctatttatatgatcacccccaatggccgtttcaagtgcaatacccgtttatgcctttcaatcaccgattttcatccagatacctggaacccagcttggagtgtctcaacgattttaacagggctcctttcatttatggtcgagaaaggcccaactctaggaagtatcgagaccagcgatttcaccaaacgccaattagcggtgcagagcctcgcatttaatctcaaggacaaggtgttttgcgaattattccctgaagtggtcgaggagattaaacagaaacagaaggcccaggacgaactttccagccggcctcagacactgccccttcccgacgttgtacccgatggcgagacacactag

SEQ ID NO: 55727 - DNA, 132 bp, Artificial Sequence
  Description of Artificial Sequence: Synthetic coding sequence
atgtcttcaacaagtagcaaacgcgctccaaccacggcaacacagcgcctgaaacaagattacctccgcattaagaaggatcctgtcccttacatctgtgcagaaccgcttccttccaacatccttgagtag

SEQ ID NO: 55728 - DNA, 216 bp, Artificial Sequence
  Description of Artificial Sequence: Synthetic coding sequence
atgagctcaacttcctccaaacgggctcctaccacggctactcagcggctcaagcaggattacctgcgcatcaaaaaagatcctgtgccctacatctgcgcagaacccctcccctccaacatcttggagtggcactatgtcgtgagggggccagagatgactccatatgaagggggatattaccacggcaagcttattttcccgagagagttctag

SEQ ID NO: 55729 - DNA, 444 bp, Artificial Sequence
  Description of Artificial Sequence: Synthetic coding sequence
atggccctgaagcgcatcaacaaggaactgtcagatctggctagagatcctcccgctcaatgctctgctggaccggtcggagacgatatgtttcactggcaagccacaattatgggacccaatgatagcccctaccaggggggagtgttttttttgacgattcattttcccacagattaccccttcaaacccccaaaggtcgccttcactactagaatctaccaccccaacattaactctaatggctcaatttgcttagatatccttaggtcccagtggagtcccgctctgaccattagcaaggtccttctgtccatttgctcattgctgtgcgatccaaacccagacgacccgctggtaccggaaattgcaaggatctacaagaccgatcgggacaagtacaacaggatatctcgtgagtggacacaaaaatatgctatgtag

SEQ ID NO: 55730 - DNA, 444 bp, Artificial Sequence
  Description of Artificial Sequence: Synthetic coding sequence
atggccctgaagagaataaataaagagctgtccgatctggcaagagacccacctgcccagtgcagcgccggtccagttggagatgacatgtttcattggcaggctacaatcatgggcccaaacgatagcccataccaagggggtgtgttttttctgacgatacactttccaacagattatccctttaagcctcctaaggtggcttttacgacgcgcatctatcatccaaatattaatagtaatggtagcatctgcctcgacatccttcgatcgcagtggtcaccagccctgactatttccaaggtccttctcagtatctgctccctcctgtgcgaccccaatcctgacgatcccctggtcccagagattgccagaatttacaaaacagatcgggacaaatacaatcggatttccagggagtggacacagaaatatgctatgtag

SEQ ID NO: 55731 - DNA, 447 bp, Artificial Sequence
  Description of Artificial Sequence: Synthetic coding sequence
atggctctcaagagaataaataaggaattgagcgacttggccagagacccgcctgcccagtgcagcgccggtcctgttggcgacgatatgttccattggcaagctactattatgggcccaaacgattctccctaccaaggcggtgtgttcttcctgacaattcacttccctaccgactaccccttcaagccccctaaagtcgcctttacaactaggatctaccaccctaacataaattccaacggatctatctgcctggacatcctccgctctcagtggagccctgctctcacaatcagcaaggtgctcctgtcaatctgtagcctgctatgcgatcctaaccctgatgacccactggttccggaaatcgccaggatatataaaacggaccgggacaagtataataggcttgccagagagtggaccgagaagtacgcaatgctctag

SEQ ID NO: 55732 - DNA, 444 bp, Artificial Sequence
  Description of Artificial Sequence: Synthetic coding sequence
atggctctgaagaggattaataaggaattaagtgatcttgctcgcgacccacctgcccagtgttcagccggaccggtgggcgacgatatgtttcattggcaagctactatcatgggtcccaacgattccccctaccaaggcggagtctttttcctgactatccattttcccacggactacccttttaaaccacctaaggtggccttcacaacgaggatctatcatcctaacattaatagcaacggctcaatctgcctggatattcttcgctcccagtggtctcccgcactgacaattagtaaagtgttgctgtcaatctgctccctgctgtgcgaccccaatccagacgatcccctggtgcccgaaattgccagaatctacaaaacggacagagacaaatacaatcggatctcgcgagagtggacacaaaagtacgccatgtag

SEQ ID NO: 55733 - DNA, 450 bp, Artificial Sequence
  Description of Artificial Sequence: Synthetic coding sequence
atgttgtcaaatcggaagtgtctcagcaaagaactttccgacctggctcgcgacccacctgcacagtgcagcgccggaccagtgggcgatgatatgttccactggcaggccaccatcatggggccaaatgacagcccctatcagggtggcgtgttttttctgaccatccacttcccaacagattatcctttcaagcctcccaaggttgcattcaccacacggatttatcatcccaatatcaattctaacggatcaatctgcctggatatcttaaggagccagtggagtccagccttgacgatatcaaaagtgctcctctccatctgttcgctgctgtgcgacccaaatcctgatgatccactggtaccagagatcgccagaatttacaaaacggaccgggataaatataatcggattagcagggaatggacacaaaagtacgcaatgtag

SEQ ID NO: 55734 - DNA, 444 bp, Artificial Sequence
  Description of Artificial Sequence: Synthetic coding sequence
atggccctgaagcggatcaacaaagagctcagcgacttagccagggatcctcccgctcagtgctccgccggacccgtcggcgacgacatgtttcactggcaagccacaatcatgggtcccaacgattcgccatatcagggtggagtattcttcttaacgattcactttcctactgattacccatttaagccgccaaaggtggctttcaccaccagaatataccaccccaatatcaatagtaacggttcaatctgtcttgatatcttgcggagccagtggagccctgcgctgactattagtaaagtgctcctgtccatttgcagtctgctgtgtgatcccaatcccgatgatcctctggtgcccgagattgccagaatttacaaaacagaccgtgacaagtataacaggatctccagggagtggactcagaaatacgccatgtag

SEQ ID NO: 55735 - DNA, 444 bp, Artificial Sequence
  Description of Artificial Sequence: Synthetic coding sequence
atggccctaaaaagaattaataaagaactgtccgacttagcaagggaccccccagcccagtgttccgccggacccgtcggagatgacatgtttcactggcaggctacaataatgggtcctaacgacagcccataccagggaggtgttttcttcctcaccatccacttccctacagattacccgttcaaacccccaaaagttgcatttacaacccgtatataccatccgaacatcaatagcaacggttctatttgccttgacatactgcgctctcagtggagccctgcgctgacgatctctaaggtccttctgtcaatttgcagcctgctgtgcgaccccaatcctgacgaccctcttgtgcccgaaattgccagaatctacaagacagaccgagataagtacaaccgtattagcagagagtggacccagaagtatgcgatgtag

SEQ ID NO: 55736 - DNA, 444 bp, Artificial Sequence
  Description of Artificial Sequence: Synthetic coding sequence
atggcactgaaaaggatcaacaaggaactttcagaccttgcccgagaccctcccgcacagtgttctgccggtccagtgggcgatgacatgtttcactggcaggcaacaatcatggggcctaacgacagtccctaccaaggcggagtgttcttcctcacaattcatttccccacggattaccctttcaaaccccctaaggttgcgtttaccactcgtatctaccacccaaacataaactctaacgggagcatctgcttagacattctccgctcacagtggtctcccgctcttaccatatccaaggtactcctgtccatctgttcgctgctttgcgacccaaaccctgacgaccccctcgtgcccgagatagcaagaatctataagaccgatagagacaaatacaacaggatcagccgcgagtggacccaaaagtatgcaatgtag

SEQ ID NO: 55737 - DNA, 444 bp, Artificial Sequence
  Description of Artificial Sequence: Synthetic coding sequence
atggcgctgaaaaggatcaacaaagaactttctgacttggcccgagatccgccagcgcagtgttccgcaggccctgtgggtgatgatatgttccactggcaggcgacaatcatgggccctaacgactcgccgtaccagggtggcgtgttttttttgaccatccactttcctacagattacccatttaagccgcctaaggtcgcatttaccactcgtatatatcaccccaatattaactcaaacgggtccatctgtctcgacatactgcgcagtcagtggagcccggctctcaccatatctaaggtgttgctcagtatctgcagcttactgtgcgaccccaacccggacgatccccttgtgcccgagattgccaggatatacaagaccgaccgggataagtataaccgcatttcccgtgaatggacacaaaaatacgccatgtag

SEQ ID NO: 55738 - DNA, 237 bp, Artificial Sequence
  Description of Artificial Sequence: Synthetic coding sequence
atggccctgaagcggattaataaggagctttcagacctggctcgagatccacccgctcagtgctctgccggtcccgttggggacgacatgttccattggcaagcgacgattatgggacctaatgattctccctatcagggaggcgttttctttctaactattcacttccccacagactatccgttcaagccaccaaaggtagcctttactacgaggatctatcatccgaacatctag

SEQ ID NO: 55739 - DNA, 291 bp, Artificial Sequence
  Description of Artificial Sequence: Synthetic coding sequence
atggccctaaagaggattaataaggaactcagcgatctggccagggacccccctgctcagtgctcagcaggtccggtgggggatgacatgtttcactggcaagcgaccatcatgggaccaaatgacagtccctaccagggcggagtattttttttgaccattcactttccaacagactatccttttaaacccccaaaggtggcatttacaaccagaatttatcatccgaacattaattcaaatgggtccatctgcttggatattcttcggagtcaatggagcccagcttag

SEQ ID NO: 55740 - DNA, 150 bp, Artificial Sequence
  Description of Artificial Sequence: Synthetic coding sequence
atggccttaaagcgtattaacaaggagctgagcgatctagcccgtgacccgccagctcaatgcagcgccggtcctgtgggggatgatatgttccactggcaggcaactattatgggcccaaacgattctccctaccaagggggtgtgtag

SEQ ID NO: 55741 - DNA, 1527 bp, Artificial Sequence
  Description of Artificial Sequence: Synthetic coding sequence
atgctgtggtttcaaggagctattcctgccgcaatcgccacggcaaaaaggtccggcgctgtttttgtcgtgttcgtggcgggtgacgatgaacagagtactcaaatggccgcttcctgggaagacgataaagttaccgaggcatctagcaatagctttgtcgcaatcaagatcgatacaaagtctgaggcctgcctgcagttctcacaaatctatcctgtggtgtgcgtgccttcttccttctttataggcgactcaggcattcccttagaagttattgccggatctgtgagtgcagacgaactcgtcacgcgaatacataaggtgagacagatgcacttgctgaagtctgaaactagtgtggccaatggcagccaatccgagtcatcagttagtaccccttcggcgagtttcgaacctaacaatacatgtgaaaattcccaatcccgtaacgctgaactgtgtgagatccctccaacctccgataccaagagcgatacggcaaccggtggcgagagtgcgggtcatgcgaccagcagccaggagccatcgggatgtagcgaccagcggcctgcagaggaccttaatatccgcgtggagcggctgactaaaaaacttgaggaacggagagaggagaagaggaaagaagaggagcagcgtgagatcaagaaggagattgaacgccgtaagacgggaaaggagatgcttgattacaaacggaaacaagaggaagaattgacgaagcgcatgctcgaggaacgaaacagggaaaaagctgaggatcgggctgcacgagaaagaatcaagcagcagatcgctctagaccgcgctgaaagagctgcaaggttcgccaagaccaaggaggaggtggaggccgctaaggctgccgctttattggccaaacaggctgagatggaggtgaaacgagagagttatgcgagagagcgctccacagtagcccgtatacagttccgacttcctgatggatctagttttaccaatcagtttcctagtgatgccccattggaagaggcgaggcaattcgctgcccaaacagttggcaatacgtatggaaatttttcccttgccactatgttcccaaggagagagttcacaaaggaggactacaaaaaaaaattgttggacctggaactggctccaagcgcttcagtggtcctgctccccgcaggccgtccaacagctagcatagttcattccagtagtggagacatttggactctcctgggcacggtcttgtacccttttttagccatctggagactgatctccaattttctcttttcgaatcctccgcctacccagactagcgtgagggtgacctcttccgagcctcccaaccctgcgagctctagcaagagcgagaagcgtgagcccgtgaggaaaagggtcctggaaaaacgcggagatgatttcaagaaagaaggtaagatttaccgcctccgcacgcaggatgacggagaggatgagaacaatacctggaatggcaactcgactcagcaaatgtag

SEQ ID NO: 55742 - DNA, 1473 bp, Artificial Sequence
  Description of Artificial Sequence: Synthetic coding sequence
atgctttggttccagggcgcaattcccgctgctatcgccacggctaagaggagcggtgcggtatttgtcgtgttcgtggcgggtgacgacgagcaatcgacccaaatggccgcttcctgggaagacgataaggtcacggaggcgagtagcaactcttttgtcgcgattaaaattgacacaaagtccgaagcctgtcttcaattcagccagatttatcccgttgtgtgcgtcccgtcatcctttttcatcggggattcaggcatcccactggaggtgatcgcagggagcgtctcagccgacgagcttgtgactagaatacataaagtccgccaaatgcacctcttgaaaacagccagctttgagcctaataatacttgcgagaattctcagtctcggaacgcagaactgtgcgagattccccctacaagtgatactaaatccgacaccgcgaccgggggagagtcagctgggcatgccacttcgtctcaagaaccttctggatgcagcgaccagcggccagcagaagatctgaacatccgcgtggagagactcactaagaagctggaagagcgacgagaggagaagcggaaggaggaagaacaaagggagattaagaaggaaatcgagcgtagaaagacgggaaaggagatgctggactataaacgaaagcaggaagaggagctgactaagagaatgctcgaggaacgtaatcgcgagaaggccgaagacagagcagcgagagagcggattaagcaacaaatagcactggatcgagcggagcgtgctgccagattcgccaaaactaaagaggaagtggaagctgccaaagcggctgccctgctagctaaacaagcggagatggaagtgaagcgagagagctacgctcgcgagagatcaacagtggctagaattcaatttagactgccagacggcagttccttcactaatcagttccctagtgacgccccattggaagaagcacggcagtttgcagctcagacagtggggaacacgtacggcaatttttcactagcaacaatgtttccaagaagagaattcacaaaagaggattacaaaaagaagctgcttgaccttgaacttgctccatcggcgtctgtggtcctgttgccggcaggacgaccaacagctagcattgtgcactcctcgagcggcgatatctggactctgctggggacagtcctgtacccgtttcttgctatatggcggttaatttcaaatttcttgttctctaatccaccgcctacacagacctctgttagggttactagttcagagccgcctaacccagcaagctcaagcaaaagcgaaaaacgcgagcccgtgcgcaagcgtgtgcttgaaaaacggggtgacgatttcaaaaaggaaggcaaaatctaccggctacgtacacaggacgacggagaagacgaaaataacacctggaatgggaactcgacacaacagatgtag

SEQ ID NO: 55743 - DNA, 1470 bp, Artificial Sequence
  Description of Artificial Sequence: Synthetic coding sequence
atggcagcgcacgggggtagtgccgctagcagcgcacttaagggcctaattcagcaatttaccacaattactggtgcttcagaaagcgtcggcaaacatatgctcgaagcatgtaacaacaacttagagatggcagttacaatgttcctggacggaggcggtatcgctgaggagccttcaacctcttcagcatccgtctccacagtccgtccacacacagaagaggaggtccgggcacctattcctcagaagcaggagatcctggtggagcctgagcctttgttcggcgcaccaaagagaagacgcccagccaggagcatcttcgatggattccgggactttcagaccgagaccatcagacaggagcaagagctaaggaacggtggcgcaatcgacaagaagctcaccactttggcagacctgtttaggccccctattgatttaatgcacaaaggctcttttgagaccgccaaagagtgtggacagatgcaaaataaatggctcatgatcaacatccaaaacgtgcaggatttcgcgtgccagtgcctgaacagggacgtgtggtctaacgaagcggttaaaaacataattagagaacactttatattttggcaggtgtatcatgactctgaagaggggcagcgatacattcagttctataaattaggagacttcccttacgtgtcaattctcgatcctcgcactggacagaaactcgttgaatggcaccagcttgacgtaagttcttttctcgaccaggtgacaggcttccttggtgaacacgggcaactcgatggactgagcagctctcctccaaaaaagtgtgccaggtccgagagcctaattgacgccagtgaggacagccagctggaggccgcaatccgcgctagcttgcaggagactcactttgattctactcagaccaagcaggattccagaagtgatgaggagtcggagtccgagctgttttctggaagcgaagagttcattagtgtttgcggatctgatgaagaggaggaggttgaaaacctggcaaagtctcgtaaaagcccacacaaggatctggggcacaggaaagaggaaaatcgccgaccccttaccgagccaccggtgcgcaccgacccagggacggcgaccaaccaccaagggttgccggcagttgactctgaaatcctcgaaatgccccctgagaaagccgacggcgtggtcgagggcatagacgtcaacggcccaaaggcccagctgatgctcagatacccagacggtaaaagggaacaaatcacactaccagagcaggctaaactgctcgcactcgttaagcacgtgcagagcaaggggtaccccaacgagagatttgagctcctgaccaactttcctagacgcaaattgagccacctggattatgatattaccctccaggaggccggactttgcccccaggagacagtgttcgtgcaggagaggaattag

SEQ ID NO: 55744 - DNA, 1026 bp, Artificial Sequence
  Description of Artificial Sequence: Synthetic coding sequence
atgcacaaagggtcttttgaaaccgcaaaagaatgtggacagatgcagaacaagtggttaatgatcaacatccagaatgtacaggattttgcctgccagtgtttaaacagagacgtctggagtaacgaggccgttaaaaacatcatccgagagcacttcatcttctggcaggtataccacgacagtgaagagggccagcggtacatccaattctataagctgggagacttcccctatgtgtccatacttgacccccgaacaggtcagaagttggtagagtggcatcagctcgacgtgtcatcattcctcgaccaagtcaccggtttcctgggagagcacggacagctggacggcctgtcatcatcgccgccaaagaagtgcgcccgatctgagtctttgattgacgcaagcgaggatagccagttggaggctgctatccgggcttcactacaggagactcattttgatagtacccagaccaaacaggacagtcggagcgatgaggaaagcgaatctgaactttttagcggcagcgaggagttcatctcggtgtgtgggtcagacgaggaagaagaggtggagaatttggctaaaagtcggaagagcccacataaagatttgggtcaccggaaggaagaaaacagaagacctcttaccgaacctcctgtgagaactgacccagggacggcgactaatcaccagggtcttccggcagtcgactccgagattctcgaaatgccacccgagaaagccgatggggtggtagagggcatcgatgtgaatgggccaaaagcacagcttatgttgcgctaccctgacggaaagcgggagcagattactctgcctgagcaggctaagctgctggcactagtcaagcatgttcagtcgaagggctaccccaatgagcggttcgagctgttaaccaatttccctagaaggaagctgagtcatctcgactatgacattactttgcaagaggccggactgtgcccccaagagactgtgttcgttcaggaaaggaattag

SEQ ID NO: 55745 - DNA, 1584 bp, Artificial Sequence
  Description of Artificial Sequence: Synthetic coding sequence
atgagaagcgataagtccgcactagtttttctgctcctacagctgttctgtgtcggatgcggcttttgtgggaaagtgcttgtgtggccctgtgacatgtctcactggcttaatgttaaggtcatacttgaggagctgattgtgagaggccacgaggtaacggtgctgactcatagcaaaccttctctgatcgactacagaaagccctccgcacttaaattcgaagtcgtgcacatgcctcaggacagaactgaggagaatgaaatctttgtagatttagccctgaatgtgttgccaggtctctccacctggcagtctgtgatcaagcttaacgattttttcgtggagatccggggtaccctcaaaatgatgtgtgagagttttatctataatcagactctgatgaagaagctacaagaaacgaactacgacgtgatgttgatcgaccctgtgattccctgcggcgatttgatggccgaactcctcgcggttccctttgtcctgaccttgcggatatcagtcggcggtaacatggagagatcctgtggcaagctgcctgcccctctgtcctatgtaccagtgcccatgactggtcttactgaccgaatgaccttcttggagcgagtgaagaattcaatgctgtctgtgttgtttcacttttggatacaagactatgattatcatttctgggaggaattctatagcaaagccctcggacgaccaacgaccctgtgtgaaaccgtaggtaaggcagagatctggttaattcgaacctactgggactttgaattcccccagccctatcagcccaatttcgaattcgtgggcggattgcattgcaagccagccaaggcattgcccaaagaaatggaaaatttcgtgcagagcagcggcgaggatggaatcgtggttttctccctcggctcactgttccaaaacgtgactgaggaaaaggctaacatcattgccagtgcactggcacagatcccccagaaagtcctgtggcgctataaaggaaagaaaccttcaactctgggggcaaatacacgtctgtacgattggataccccaaaacgaccttttaggccaccccaagacaaaggccttcataacacacggcggtatgaacggtatttatgaagcgatatatcacggcgtgccaatggtgggggtcccaatttttggggatcagttggacaacattgcccacatgaaggccaagggcgctgccgtggagatcaacttcaagacaatgacctctgaggaccttctgcgggcactcaggaccgtcattacagactcctcttataaggagaatgctatgcggctcagccggattcatcatgaccagccagtaaagcccttggatagagcggtattctggattgagtttgttatgaggcacaaaggagctaaacacttgagaagcgccgcacatgacctgacttggtttcagcactacagcatcgatgtgatcggatttctgctggcctgtgtggctactgcgatcttcctgttcaccaagtgtttcctgttcagctgtcagaagttcaacaagaccaggaagattgagaagcgggaatag

SEQ ID NO: 55746 - DNA, 717 bp, Artificial Sequence
  Description of Artificial Sequence: Synthetic coding sequence
atggagaattttgtccagagctcgggcgaggatggaatagtggtattctctttggggtccttgtttcagaatgtcaccgaagaaaaggcgaacatcatcgcatctgcactggcccagattccccagaaggtactgtggcgctataagggtaagaaaccttctaccctgggagcaaatacgagattgtatgactggatacctcagaatgacctcctcggccaccccaagaccaaggcctttataactcacggaggtatgaacgggatttacgaagccatttatcatggcgtccctatggtgggagtccctattttcggagaccagttggataatatcgctcacatgaaggccaagggagcagccgtggagatcaattttaagacgatgactagtgaggacctactccgtgcattacggaccgtgatcactgattcgtcatacaaagagaacgcaatgcgtctgtcccgcattcaccatgaccagcctgtcaagcctcttgatagggctgtgttttggattgagtttgtcatgaggcataagggggctaagcacctaagaagtgccgcacacgacctgacctggtttcaacactattccatcgatgtcatcggtttcctgctggcctgtgtggctaccgccattttcctgtttactaaatgttttctattcagctgccagaagttcaataaaacccgcaagattgagaaaagagaatag

SEQ ID NO: 55747 - DNA, 1587 bp, Artificial Sequence
  Description of Artificial Sequence: Synthetic coding sequence
atggcactcaaatggacgacagttctcctcattcaactgtctttttatttctctagtggcagctgtggtaaggttttggtatgggctgcggagtactccctgtggatgaacatgaagaccatcctgaaggagctggtgcagcgcggacacgaggttacagttctcgcgagctcagcatcaatcttatttgatcctaacgacagcagcacactgaaactggaagtctatcccacctctttaaccaaaaccgaatttgaaaacattataatgcagctcgtgaagcgtctgagtgagatccaaaaggacacgttctggcttcctttttcgcaggagcaggaaatcctatgggctatcaacgatattataagaaatttttgcaaggatgtcgttagtaataaaaaactaatgaagaagttacaggaaagccgcttcgatatcgtctttgccgacgcctatctgccttgcggagagctcctggcagagctatttaatattcctttcgtgtactctcattctttcagtcccggttattccttcgagaggcattcaggcggtttcattttcccaccaagctatgtgcccgttgtcatgtctaagctttccgaccaaatgacgtttatggaacgagtgaaaaacatgctctatgtgctgtattttgacttttggtttcagatatttaacatgaagaaatgggatcaattttattcggaagtactgggtagacctacaaccctcagcgaaacaatgcggaaagcggatatatggctcatgcgtaatagttggaacttcaaattcccccacccgtttctcccgaacgtcgactttgtgggtgggctgcactgcaagcccgctaaacctctcccaaaagagatggaggagttcgtccaatcatccggagaaaatggggtggtagtcttctcactgggatccatggtcagcaacatgaccgaggaacgcgcaaacgtaatcgcgaccgcattggccaaaatcccacagaaagtgctgtggcgctttgatggtaacaaacctgacgcattgggcctgaatacaagactgtacaaatggataccacagaacgacctccttgggcaccccaagaccagagctttcattacccacggtggcgctaatggcatctacgaggccatctatcatggtatccccatggtcggaataccccttttttttgaccagccagataacatcgctcacatgaaagctaagggagcggcagtgcgggtggattttaacacaatgagctcaaccgacctactgaacgctctgaaaactgttatcaacgatccttcctacaaagagaatatcatgaaattgtcccgcatccagcacgatcagcccgtgaagcctctcgaccgcgcagtgttctggattgagtttgtgatgcggcataagggtgccaagcacctgagggttgctgcccataacctgacatggtttcagtaccacagcctggacgtgatcggcttcttactggcctgtgttgctacggtcctctttatcatcacaaaatgctgtctgttctgcttctggaagttcgcccgaaagggaaaaaaagggaagcgcgactag

SEQ ID NO: 55748 - DNA, 1572 bp, Artificial Sequence
  Description of Artificial Sequence: Synthetic coding sequence
atggtcggccaacgggtgctgttattagttgccttcctgctgtccggagtactgctatcggaggccgctaagatccttacaatatctacgcttggagggtcccactaccttctgcttgacagggtttctcagattctgcaagagcacgggcacaatgtgacaatgttgcaccagtccggcaagtttctgatacctgatatcaaggaggaggaaaagtcatatcaggtcatccggtggttttcacccgaggatcatcaaaagagaataaagaagcactttgactcatacatcgaaacggctctagatggcaggaaggagagtgaggccctggtgaagttgatggagattttcggaactcagtgctcttaccttctttccagaaaggacataatggacagcctgaagaatgagaactatgacctcgtgttcgtggaagcctttgatttttgcagttttctcatagccgagaaacttgttaagccctttgtggccatacttcccacaacgtttggctccctggactttggactgccttcccctctcagctacgtcccagtgttccccagcctgttgacagaccatatggatttctggggcagagttaagaatttcctcatgtttttttccttttcgaggtcacagtgggatatgcaatccacgtttgacaataccatcaaggagcacttccccgagggcagcaggcctgttctctctcacctgctcctcaaggctgagttgtggtttgtgaattcagactttgccttcgacttcgccagaccactgttgcccaacaccgtgtatatcggcggactgatggagaagccaattaagcctgtgcctcaggacctcgacaattttatcgccaatttcggggacgctggctttgtgctcgtggcgtttggctctatgctcaatactcaccagtcccaagaggtgttgaaaaagatgcacaacgccttcgcgcatctcccccaaggcgtgatatggacctgtcagtcctcacattggccccgagacgttcacctggctaccaatgtgaagatagttgactggctgccacagtcggatttgctggcacacccctcaattcgtttattcgttacacatgggggacagaattccgtcatggaggctattcggcacggcgtacctatggtcggtctgccggtcaatggcgaccagcatggtaacatggtcagggtggtggccaagaattatggcgtgagtatcaggttgaatcaggtcacagccgacacactgaccctgactatgaagcaggtcatcgaagacaagagatataagagcgccgtcgtcgctgctagcgtgattctccatagtcagccactgagccccgcacaaagactcgttggttggatcgatcacattctgcagacgggaggtgccacccacctcaagccatacgcatttcaacaaccttggcatgagcagtatcttatcgacgtgttcgtatttctgctgggcctgaccctgggaaccatgtggctgtgcgggaagctcctgggcgtggtggcacgttggctccggggtgcgagaaaagtgaagaagacatag

SEQ ID NO: 55749 - DNA, 759 bp, Artificial Sequence
  Description of Artificial Sequence: Synthetic coding sequence
atgctacaccagtccggcaagtttctaataccagatattaaagaagaggaaaagtcctaccaagtgatccgttggtttagccccgaagaccaccagaaaagaatcaagaaacactttgactcatatattgagactgccctcgatggaaggaaagaatctgaggcacttgtgaaactgatggagatcttcggcacccagtgctcttaccttctgagccgcaaagatatcatggactcactgaagaatgaaaattatgatttagttttcgtggaggcctttgacttttgtagcttcctgatcgctgagaaattagtgaagcctttcgttgccatcttgcccacaacattcgggtccctcgattttgggctcccgagtccgttatcttacgtgcccgtgtttccgtcactgttaaccgaccatatggacttttggggtcgcgtgaagaacttcctgatgttttttagcttttcaagaagtcagtgggacatgcaatctacgtttgacaacactatcaaggagcacttcccagaaggctcaaggccagtattatctcatctgctcctcaaagcagagctgtggtttgtcaacagcgacttcgcgttcgattttgcacgtccattgctccctaacacagtctacataggaggactgatggaaaaacccattaaaccagtgcctcaaaacggccagcccgctctgtttaccacaccctcactgttcagtagtggcgtgtacccagaacctctgaggtggctgtag

SEQ ID NO: 55750 - DNA, 1626 bp, Artificial Sequence
  Description of Artificial Sequence: Synthetic coding sequence
atgaagtcttacactccttacttcattctcctttggtcagctgtgggaattgcaaaggcggcaaagattatcattgtgccgccaattatgtttgagtcacatatgtacatttttaaaaccctcgcatctgcacttcacgagcgcggtcatcacactgtgttcttgctctcggaaggcagagacatcgctccgtcgaatcactacagcctgcagcgctatcctggaatattcaattcaacaacctccgacgcctttcttcagagtaagatgagaaatatcttttccggcaggctgaccgctattgaactatttgacatactggaccattacacaaagaattgcgacttgatggtgggcaatcatgcactgattcaagggctgaaaaaggagaagttcgatctgcttttggtagatcctaacgatatgtgcggattcgtgatagctcatctgcttggcgtgaagtatgcagttttcagcaccggattgtggtatcccgcagaggttggcgctcctgccccactcgcatacgtacccgagtttaacagccttctcacagaccggatgaacctccttcagagaatgaagaataccggtgtgtacctcatttctaggctaggcgttagcttcctcgtcctcccgaaatatgagaggatcatgcagaaatataatctgctgccggaaaaatcgatgtacgatctggtccatgggagttcactgtggatgctgtgtaccgacgttgcgctggaatttcccagacccaccctcccaaatgtagtgtacgtcgggggaatccttacaaagcctgcttcccctctgccagaagatctgcagagatgggtaaacggtgcaaatgagcacgggtttgtccttgtcagctttggagcgggagtcaaatacctgtcagaagatatcgcaaataagctcgctggcgctctagggaggctgcctcagaaggtgatttggcgattcagcgggccaaagcctaaaaacctcggcaataatacgaagcttatcgagtggctcccgcagaatgatctccttggccattcaaaaattaaggctttcctgtcacatgggggtctgaactccatttttgagaccatctaccatggcgtgcctgtggtgggtatcccgctcttcggcgaccactatgacactatgacccgagtccaggcaaaggggatggggattctgttagaatggaaaacggtgacagagaaggaactctatgaggccctggtcaaggtcattaacaatcctagctatcgccaaagagctcagaagctgtcagagatccacaaggatcagccgggtcaccctgtcaacaggaccatatattggattgactacattataaggcataacggagcacaccaccttcgagcggctgtgcaccagattagcttctgtcagtatttcctgctagacatcgctttcgtgctgcttctgggcgctgcgttgctctactttttgctctcctgggttactaagttcatctaccgaaaaattaagtccttatggagcaggaataaacattctacagtgaacggccactaccacaacggcattctgaacggcaagtacaagcgcaatggacatatcaagcatgagaagaaggttaaatag

SEQ ID NO: 55751 - DNA, 1626 bp, Artificial Sequence
  Description of Artificial Sequence: Synthetic coding sequence
atgaaaagctacaccccgtatttcatcctgctgtggtccgcagtgggcattgccaaagccgctaagattataattgtacctccaatcatgttcgagtcacacatgtatatcttcaagacattagccagcgccttacacgagcgaggccaccataccgtttttttactgtctgagggtcgtgacatagcaccctctaaccactattccctgcagcgctatcctggcatatttaactcgactacaagtgacgctttcctccagagcaagatgcgtaacattttttctggccgtctgactgccatcgagctgttcgacatcttggaccattacacaaagaattgcgacctcatggtcgggaatcatgcactgattcagggactcaagaaagaaaaatttgatcttctgcttgtggaccctaacgacatgtgtggattcgtgatcgctcacttgctaggcgtgaagtacgcagtcttctctacagggctgtggtacccagcagaggtgggagccccagcccctttagcctacgtgccagagtttaattctctcctcaccgaccggatgaacctgcttcagagaatgaagaacacaggagtctatctaatttcccgcttaggggtgtctttcctggtcctcccaaagtacgagcgaataatgcagaagtacaacctcttacctgagaaatcgatgtacgatctcgtccacggaagttccctgtggatgctttgtactgacgttgctctggaatttcccagacccacattacctaacgtcgtctacgtggggggtatactgacaaagcccgcatcaccccttcctgaggacctccaaaggtgggtgaatggcgcaaatgaacacgggtttgtgctcgtaagctttggggcaggtgttaagtacctgtcagaggacattgccaacaaactggctggcgcacttggccgactcccacaaaaagtgatctggcgcttctctgggcctaaaccaaagaatcttggtaacaacacaaagcttatagaatggttgccccaaaacgacctgctgggccattcaaagattaaggcttttctatctcacgggggtctgaatagcatttttgagaccatttatcacggcgtccctgtggtgggcattcctctgttcggcgatcactacgacactatgactagggtgcaagcaaaaggaatggggattctgctggaatggaagaccgttacagagaaagaactctatgaggctttagtcaaggtgattaataacccttcctacagacaaagagcacaaaagttgtcagaaatccacaaggaccagccaggacatcctgtgaatagaacgatctactggattgactacatcatccgacataacggggctcaccatcttagagctgccgtgcaccagatcagcttttgtcagtattttttgctggatattgcttttgtgttgctattgggcgctgcactgctgtatttcttactttcctgggtgactaagttcatttatcggaagatcaagagtctgtggagtcgtaataagcatagcactgtcaacggccattaccataatggaatcttgaatggaaaatataagagaaatgggcacatcaagcacgaaaagaaggtcaagtag

SEQ ID NO: 55752 - DNA, 426 bp, Artificial Sequence
  Description of Artificial Sequence: Synthetic coding sequence
atgaagtcttacacaccctattttatccttctttggtcggccgtgggtattgcaaaggctgctaagattatcatcgtaccacctatcatgttcgagagtcacatgtacatttttaagacattggccagcgcactgcacgaacgaggtcatcatacagtcttcctcctctcggaaggtcgggacatagccccatctaatcattactctttgcagcggtatccaggcattttcaacagcactactagcgatgcttttttacagagtaaaatgaggaacatcttctccggcagactaaccgctatcgaactttttgatatattggatcactacactaaaaattgcgatcttatggtcggaaatcacgctctcatccaaggcctgaagaaagagaaattcgatctgcttctggtcgaccccaacgattag

SEQ ID NO: 55753 - DNA, 990 bp, Artificial Sequence
  Description of Artificial Sequence: Synthetic coding sequence
atgaagctgctgaggagagcttggcgcaggcgggctgctctcgggctcggcacgctggccctgtgcggcgctgccctgctgtatttggccagatgcgctgccgagccaggagatcctagggctatgtcggggagatctccccctccccctgccccagccagagcagccgcattcctggctgtcctggtggctagcgcacctcgagccgctgagcggaggtctgtgatcagatcgacttggttagcccgacggggtgcacctggggacgtgtgggcaaggttcgctgttggcacggcaggactcggggctgaggagcggagagcgttagagagagaacaagcaagacatggtgacctgctgttacttcccgctctgcgagacgcctacgagaacctgaccgctaaagtcctggcaatgctcgcctggctggacgagcacgttgctttcgagttcgtgctgaaagctgacgatgactctttcgcaaggcttgacgctttgctcgctgaacttcgggctcgtgaacccgctaggagacggaggctgtattggggcttcttttcaggcaggggcagggtgaagcccggtggcaggtggcgcgaggctgcctggcagttatgtgattactatctgccttacgccctggggggaggctacgtcctgtccgcagacctggtgcactacctcaggctgagcagagactatttaagagcatggcactctgaggacgttagcctcggcgcttggttggcccctgtagacgtgcagagagagcacgatcctagattcgatacagaatatcggagtagaggatgctcaaatcagtatttagtcactcataagcaatcactggaagatatgctggagaagcacgccacattggcacgtgaggggaggctgtgtaaacgcgaagtgcaactcagactatcttatgtttacgattggagcgctcccccttcacagtgttgccagcggcgagaggggattccttag

SEQ ID NO: 55754 - DNA, 981 bp, Artificial Sequence
  Description of Artificial Sequence: Synthetic coding sequence
atggcctcaaaagtgagctgtctctatgtgctgaccgtagtatgttgggcaagtgctctctggtacctctcaataacaaggcctacttcatcatacaccggaagcaaaccctttagtcatctcacggtcgccagaaagaatttcacctttggaaacatccgcacacgccctattaatcctcatagttttgaatttctgataaatgagcctaacaagtgcgaaaagaacattccatttctagtcattctcatctcgaccacccacaaagagttcgacgcccgtcaggcgatccgcgaaacatggggagatgagaacaactttaagggcatcaagatcgctaccctgttcctccttgggaagaatgcggatcctgtcctcaaccagatggtggagcaggaatctcaaattttccatgacatcatcgtggaggacttcatagactcataccataaccttacactcaaaactctgatggggatgcgctgggtggcgacattctgctcaaaggctaagtacgttatgaagaccgattctgacatctttgttaatatggataatctcatctataaactgctgaagccgagcacaaagcctcggaggcggtactttactggatacgttattaacggcggacccatcagagatgtccggtcaaagtggtacatgcctcgagacttatatcccgattccaactatccacccttctgcagcggcactggatacattttttctgctgacgtggcggagctcatttataaaaccagcttacacacacgcctgttgcacctggaggacgtctacgtgggactctgtctgcgaaaactcggcatccatccttttcagaattcgggatttaaccactggaaaatggcttattccctgtgcagatataggcgtgtcatcactgtgcaccagatctcacctgaagagatgcaccggatctggaatgacatgagctccaagaaacacttgcgctgttag

SEQ ID NO: 55755 - DNA, 981 bp, Artificial Sequence
  Description of Artificial Sequence: Synthetic coding sequence
atggccagcaaagtgtcctgtctttacgtgctcacggtggtatgctgggcttcggccctgtggtatctcagtatcacccgcccaacaagttcttacacgggttcaaagcctttttctcacctcaccgtcgccaggaaaaacttcacctttggaaacatccgcacacggcctatcaatccccatagttttgagtttctcatcaatgagccaaacaaatgcgagaaaaatatcccatttctggtcattttgattagcaccacacacaaggaattcgacgctcgacaggctattcgcgagacatggggagatgagaacaactttaaaggcatcaaaatcgcaaccttgtttctgctaggaaaaaacgccgaccccgtgcttaatcagatggtggaacaggagagccagatttttcatgacataatagtggaggattttattgactcctatcacaacctcactctgaagacgctgatgggcatgaggtgggtagcaacattttgctccaaggccaagtacgtaatgaaaactgacagtgatatttttgtgaacatggataaccttatatacaagttactcaaaccgagcacaaagccacgccgacggtacttcacaggttacgtgataaacggcggtcctatcagagacgtgcgttccaagtggtatatgcccagggacttatatccggactcaaactatccacccttctgctccggaacaggttacattttctcggctgacgtagccgaactaatctacaagactagcctgcacacccgcttgcttcacttagaagatgtgtatgtcggtttgtgtctgagaaaattgggtatccacccctttcagaattctggctttaaccattggaaaatggcttattccttatgtagataccgtcgggtgatcaccgtgcatcagatttccccagaggaaatgcataggatttggaatgacatgtccagcaagaagcatctccgctgctag

SEQ ID NO: 55756 - DNA, 1248 bp, Artificial Sequence
  Description of Artificial Sequence: Synthetic coding sequence
atgcagatgtcctatgctatccggtgtgccttttaccagttgctactggctgctcttatgcttgtggctatgctgcagctgctgtacctttccttgctgtcagggctgcatggtcaggaagagcaggaccagtacttcgagttttttcccccatctccgagaagtgtggaccaggtcaaggcacaactgaggactgccctagcaagtggcggtgtgcttgacgcctcaggagattatagagtgtacaggggcctgctcaaaactactatggatcctaacgatgtgatcctcgcgacacacgcctcagtcgacaacctgctgcatttatccgggctgctggaacgctgggaagggccactgtctgttagcgtgtttgccgctaccaaagaggaagcacagctggccaccgtgctcgcttacgcattgtcatcccactgtccagacatgcgggctcgcgttgccatgcacctggtgtgccccagcaggtacgaggctgcagtgccagaccccagagagccgggtgaattcgctctcctgcggtcttgtcaggaggtctttgataagcttgctcgggttgcccagcccggtatcaactacgccctcggcacaaatgtcagctaccctaacaacctgttgcggaacctggctagagagggcgcaaattacgccctggtcattgatgtcgacatggtccctagtgagggcttatggcggggactccgggagatgctggatcagagcaatcagtggggtggaacggcattggttgtcccagccttcgaaatccgtagggcacgaagaatgcctatgaataaaaacgagctggtccagctgtaccaagtgggagaagtgcgcccattttattacggcctctgtacgccatgccaggcccctacaaattacagccgttgggtgaatctcccagaggagagtctcctgaggcccgcttacgtcgtaccatggcaggacccatgggagcctttctacgtggccggagggaaggtcccgacctttgacgaacgattcagacaatacgggttcaatcggatctcgcaggcttgtgaactgcatgtggccggatttgattttgaggtgcttaatgagggctttctggtgcataaaggatttaaggaagccctgaagttccatccccaaaaggaagcagagaaccagcataataagatcctttaccgacaattcaagcaggaactaaaagcgaagtatcctaactccccacgcaggtgttag

SEQ ID NO: 55757 - DNA, 561 bp, Artificial Sequence
  Description of Artificial Sequence: Synthetic coding sequence
atggtcccatccgagggcctgtggcggggtttaagggagatgctggaccaatccaatcaatggggtggaactgcattggttgtgcccgcattcgagattcgccgagcaagacgaatgcccatgaacaaaaatgaactcgttcagctctatcaagtaggcgaggtgaggcctttttactacggattgtgcaccccttgtcaagctcccacaaattacagtcgctgggtgaatttgcccgaggagtccctgctcagaccagcttacgtggtgccatggcaggatccctgggaaccattttatgtcgccggtgggaaggttccaacgtttgacgaacgattccgtcagtatggttttaaccgtatctctcaggcctgcgagctgcacgttgcagggttcgacttcgaggtactcaacgaggggtttctggtccataaggggtttaaggaggctttgaaatttcacccgcagaaggaagctgaaaaccagcacaataagatcctgtacaggcagttcaagcaggagctaaaagcgaagtatcctaattctccacgcagatgctag

SEQ ID NO: 55758 - DNA, 1194 bp, Artificial Sequence
  Description of Artificial Sequence: Synthetic coding sequence
atgtccgtcgggaggagaagaatcaaattactaggaatcttaatgatggcaaatgtgttcatctacttcatcatggaagtttcaaagtcttcgagtcaggagaagaatggaaagggggaagtgatcatccctaaagagaaattctggaagatctccactccacccgaggcatattggaaccgggagcaggaaaagctaaacaggcagtataacccaattctatcaatgctgacaaatcagaccggtgaggctggcaggctgtccaacatttcacacctcaattattgcgaacctgacctccgcgttacttctgttgtcactggattcaacaatctccccgatcgcttcaaggacttcttactgtacctgcgctgccggaactattctttgctgattgaccagcccgacaaatgtgcaaagaagccatttctattgctcgctataaagagcctaaccccccatttcgctagaagacaagccattcgcgaaagctggggacaggaaagcaatgctggcaatcagacagtcgtgcgtgtgtttttactcggtcagacacccccagaggataaccaccccgatttaagcgacatgctgaagtttgagagtgagaagcatcaggatatactgatgtggaactatcgcgatactttctttaatcttagcttgaaggaagtcctattcctcaggtgggtgtctacatcctgccccgatactgaatttgtctttaaaggggatgatgacgtcttcgtaaacacgcatcacatattaaattaccttaactctttgagcaaaactaaggccaaagatctgtttattggagacgtgatacacaacgctgggcctcacagagataaaaaactgaaatactacatccctgaagtggtgtactctggtttatatcctccttacgcgggaggaggaggatttttgtactccggtcacttggctctgcggctgtaccacattaccgaccaggtgcatctgtacccaattgatgacgtctacacaggaatgtgtctgcaaaagcttggcctggtccctgagaagcacaaagggttccggactttcgacatagaggaaaaaaacaagaataatatctgcagttatgttgacctcatgctcgtgcatagtagaaaacctcaggaaatgattgatatttggagccagctgcaatccgcacacctgaaatgttag

SEQ ID NO: 55759 - DNA, 1194 bp, Artificial Sequence
  Description of Artificial Sequence: Synthetic coding sequence
atgtctgtgggcaggagaagaattaagctgctggggattctgatgatggctaatgtctttatctactttatcatggaagtcagcaaatcctcctctcaggagaaaaacggaaagggtgaagtgatcattcccaaagagaaattctggaaaatcagcaccccgcctgaagcctactggaatcgcgaacaagagaagctgaacaggcagtacaacccaatactttcaatgctgaccaaccagaccggcgaggccggaaggttgtccaatatctcccacctgaactactgcgaaccagatttgcgagtcactagcgtggtgactggattcaacaatctccctgaccggttcaaggactttcttctttatctaaggtgccggaactacagcttgcttatcgatcaaccggacaagtgtgcgaagaagccctttctcctgctggcaattaaaagtctaactccccacttcgcgcgacgccaggcgatacgtgagtcctggggccaagagtctaacgcaggcaatcagaccgtcgtgcgcgtttttctgctgggtcagaccccgcctgaagacaaccacccagacttgtcagacatgttaaagttcgaaagtgagaagcaccaggatatcttgatgtggaactacagagacaccttttttaacctttcactgaaagaggtactgttcttaaggtgggtgtccacgagttgccccgataccgagttcgttttcaaaggggatgatgacgtgttcgtgaacacccaccacatcctcaattacttgaactccttaagtaaaactaaggctaaagacctgttcattggcgatgtgattcacaacgcaggtccccaccgggacaagaagctgaaatattatatccctgaggtcgtgtattctggcctctatcccccttatgcaggcggtggagggtttctctatagcggccacctggccctgagactgtaccatattaccgatcaggtgcatttgtacccaatcgacgatgtgtacacaggtatgtgcctccagaagctgggacttgtgcctgagaaacataaagggttcaggacatttgatatagaggaaaaaaacaagaataatatctgttcttacgtggatttgatgctcgtccactcaagaaaaccacaggagatgattgatatctggtcccaattgcagtccgctcacctgaagtgttag

SEQ ID NO: 55760 - DNA, 1137 bp, Artificial Sequence
  Description of Artificial Sequence: Synthetic coding sequence
atgcgtatgctggtttctggtagacgggtgaagaaatggcagttaattattcagttattcgccacctgtttccttgcctccctcatgtttttctgggaaccaattgataatcatattgtgagccatatgaagagctacagctatagatatctgattaattcatatgattttgttaacgatacacttagcctgaagcatacatcagccggtcccagatatcagtacctgataaaccacaaggagaaatgccaggcgcaggacgtgctcctgttactgttcgtaaagactgcaccggagaactacgacaggaggagcggcatacgaaggacatggggcaatgaaaactacgtgagaagtcagctgaatgccaatatcaaaacactcttcgcgctcggcactcctaaccctttggagggcgaagagctgcagcgtaagctcgcatgggaagatcagaggtataacgacatcatccagcaggattttgtggacagtttctataatctgactctgaaattgctcatgcagttctcctgggccaacacatactgtccacacgcaaaattccttatgaccgcagatgacgatatctttattcacatgcccaacctgatagagtacctgcaaagcctggagcagatcggggtccaggatttttggattgggcgagtacatcggggagcccctcctatccgcgataagagcagcaagtactacgtgagttacgaaatgtatcagtggcctgcgtaccctgattacaccgcgggtgctgcctacgtaatctctggcgatgtggcggcaaaagtgtatgaagcatctcagacacttaactcatctctttacattgacgacgtatttatgggactgtgcgcgaataagattggcatcgttcctcaagaccatgttttcttctccggagaaggcaaaacaccataccatccctgcatttatgagaagatgatgacaagtcatggccatctcgaggatctgcaggatctgtggaaaaatgccactgatcccaaggtaaagactataagtaaaggcttcttcggccagatttactgcagattgatgaaaattattcttctctgtaagatttcttatgtcgatacatatccatgcagagcggcatttatatag

SEQ ID NO: 55761 - DNA, 1137 bp, Artificial Sequence
  Description of Artificial Sequence: Synthetic coding sequence
atgcgaatgctggttagcggacggcgagtcaaaaaatggcaactcattattcagttgttcgcaacatgctttttagcgtccctgatgttcttctgggaacctattgataaccatatagtaagtcatatgaaaagttatagctacagatacctcattaacagttacgatttcgtcaatgacaccctgagtctaaaacacaccagcgcaggacctagatatcagtacctgattaatcataaagaaaaatgccaggcgcaggacgtgctcctactgctgttcgtgaagactgcacccgaaaattatgaccgcagatctggcataaggcggacctggggaaacgagaattacgtgaggtcacaactgaacgccaacatcaagactctattcgccctcggcacccctaatcctttggagggagaggagttgcagcgcaaactggcttgggaagatcaaaggtataacgatattatccagcaggactttgttgatagcttttacaacctgacactgaaactacttatgcagttttcttgggccaatacttactgcccccatgccaaattcctgatgaccgctgatgacgacatattcatccacatgccaaaccttattgaatatctccagtcactggagcagatcggggtccaagacttctggatcggtagagtgcacaggggtgcccctcctatcagggacaaaagctctaagtattacgtgtcctacgaaatgtatcagtggcctgcttaccccgattacaccgccggtgcagcgtatgtgatcagcggcgatgtcgccgctaaagtttacgaggccagtcaaaccctgaactcctcgctgtatattgatgatgtgttcatgggtttatgcgctaacaaaatcggaatcgtgcctcaggatcatgtcttcttttcaggtgagggtaagaccccataccatccttgtatttacgaaaagatgatgacgtcccacggccacctggaagatctccaagacctgtggaaaaacgctactgacccaaaagtgaagactattagcaaaggtttcttcggccagatatattgtcggctcatgaaaattattctcctgtgcaaaataagctatgttgacacatatccttgtagagccgctttcatatag

SEQ ID NO: 55762 - DNA, 189 bp, Artificial Sequence
  Description of Artificial Sequence: Synthetic coding sequence
atgcgaatgctggtgagtgggcgtcgagtgaaaaaatggcagctgataatccagctttttgcgacctgtttcctggcctcgctaatgtttttctgggaacccatcgataaccacatcgtgagccacatgaagagttattcatatcggtacctgatcaatagctacgactttgtcaacgatacactctag

SEQ ID NO: 55763 - DNA, 246 bp, Artificial Sequence
  Description of Artificial Sequence: Synthetic coding sequence
atgcggatgctggtttcaggacggagagtgaaaaaatggcagctcatcatccagctgttcgctacatgttttctcgcaagcctgatgttcttctgggagccaatagacaatcatattgtgagccacatgaaatcctattcctacagatacctgattaattcctacgactttgtcaacgatacactcagtctcaagcatacaagtgccggaccgaggtaccagtatctgattaatcacaaagagtag

SEQ ID NO: 55764 - DNA, 1137 bp, Artificial Sequence
  Description of Artificial Sequence: Synthetic coding sequence
atgcgcatgctggttagcggtaggcgcgtgaagaaatggcagctgatcatccaattgttcgctacatgctttctagcctccctaatgttcttctgggaacctattgacaaccatattgtttcccacatgaaatcttactcgtaccgttacctcatcaacagctatgatttcgtcaatgacaccctgtccttgaagcacaccagcgctggacctaggtatcaatacttaattaatcacaaggaaaagtgtcaagcccaggacgtcttgctgctcctatttgtgaaaacagccccagagaattacgaccgcagatcagggattaggaggacctggggcaatgagaactatgtgaggagtcagctcaatgccaacattaagaccctcttcgcattgggaacgcccaaccccttggaaggcgaggagctccagcgaaagcttgcctgggaggaccagcgttataacgacataatccagcaggactttgtggattccttctataacctgactctgaagcttctgatgcagttctcctgggctaatacctactgtccccatgccaaattcctgatgaccgcagatgacgacatctttatccacatgccgaacctgatcgagtacttgcagtccctagagcaaattggggtgcaggatttctggatcggacgcgtgcaccggggagctcctcctattagggacaagagctcgaagtactacgtgtcttacgagatgtatcagtggcctgcatacccagactacacggcaggggcagcctatgtcatcagcggcgacgtcgccgctaaggtgtatgaggcttcacagaccttgaactcaagtctctacattgacgatgtgttcatgggactgtgcgcaaacaagatcggtatcgttccgcaggaccatgtatttttttctggagagggtaagacaccctatcatccgtgtatttacgaaaagatgatgacctcacatggtcacttggaggatctccaggatctctggaaaaacgccactgaccctaaggtcaagactatcagcaagggtttttttggccagatctactgtcgacttatgaagataatactcttatgcaaaatttcctatgttgatacctatccatgcagggcagccttcatatag

SEQ ID NO: 55765 - DNA, 153 bp, Artificial Sequence
  Description of Artificial Sequence: Synthetic coding sequence
atgagaatgctcgtgagcggtcgacgagtcaagaaatggcaattgattatccaattgtttgcaacatgcttcctggcgtccctaatgttcttttgggagcccattgataatcatatagtatcccacatgaaatcctatagctatcggtactag

SEQ ID NO: 55766 - DNA, 1206 bp, Artificial Sequence
  Description of Artificial Sequence: Synthetic coding sequence
atgagcctgtggaagaaaacagtctatcggtccctgtgtttagccctggctctgctggtagccgtgaccgtcttccagaggtctttgaccccaggacagtttctacaggaaccccctcccccaacactagaacctcaaaaggcacagaagcccaacgggcagctcgttaaccctaacaatttttggaagaaccctaaagacgttgccgcaccgacaccgatggcctcccaggggccacaggcctgggacgtgacaactacgaactgctcagcgaacatcaatttgactcatcagccttggtttcaggttttagaaccccaattccgccagtttctgttctatcgacattgccggtattttcctatgctcctcaaccatccagaaaagtgccgcggtgacgtatatctcttggtggtggtaaagagtgtaatcacacagcacgatcgcagggaggcgatccgccaaacctggggtcgggagcggcaaagcgctgggggaggccgaggagccgtaaggacactatttctgctcggcacggcatcaaaacaggaggagcggacccactaccaacagctcctggcatacgaagatcgtctttatggggatatccttcagtggggcttcctcgacacctttttcaacctcactctgaaagagatccattttctcaaatggctcgatatatattgcccacatgtaccattcatatttaagggagacgacgacgtcttcgtgaatccaacaaacttgctggagttcctggccgacaggcagccacaggagaacctcttcgtgggagatgtgctccaacacgccagaccgatcagaaggaaggacaataaatattacatacctggggcactgtacggcaaagccagctatcctccctacgctggaggcggtggctttctgatggccggatctctcgctcgcagattgcatcacgcttgcgacactttggaactttacccgatcgacgacgttttcctcggcatgtgcttggaagtattaggcgtgcagccaaccgcacatgaggggttcaagacctttggcatttcaagaaatcggaattctcgcatgaacaaggagccctgtttttttagggctatgctggttgtccataaactcctgccccctgagctcctcgccatgtggggactggtccactccaacctgacctgtagcaggaaactgcaggtgttatag

SEQ ID NO: 55767 - DNA, 1194 bp, Artificial Sequence
  Description of Artificial Sequence: Synthetic coding sequence
atgcgctgccctaaatgtttactttgtctgtctgcgctgttgactctgctggggttgaaagtgtatatagagtggacaagtgaatccagattgagtaaggcctatccatcacctcgaggcaccccaccttcacccacaccggctaaccctgaacccactttacccgcaaacctgagcacgaggctcggacaaactattcccttgcccttcgcctactggaaccaacagcaatggcggctaggaagtttgccttccggggactccactgaaactggtggttgtcaggcatggggggcagcggctgccacggagattccagacttcgcatcttaccccaaggatcttcggagattcctgctgtctgcagcttgtagatcgtttccacagtggctgcctggcggtgggggttcccaagttagctcctgtagcgatacagatgtgccatacctgttactcgcagtgaagagtgaaccgggacgctttgcagagaggcaggcagtgcgtgagacgtggggatcgccggctccagggatccgcctgctattcctacttggcagccctgtgggcgaggcgggaccggacctggactctctcgtggcctgggaaagcagaagatactccgacctcctgctgtgggattttctcgatgtcccgttcaatcagactttgaaggacctgctgctccttgcctggcttggcaggcactgtcctaccgtctcttttgtgcttcgggcacaggatgacgctttcgtgcacacccccgctctgttagcccatttgcgtgctctcccccctgcctctgccaggagtctctacctcggggaggtgttcacccaggctatgccgctgcgcaaacctggaggaccattctacgtacctgagagcttctttgaaggcggttaccccgcttatgcttctggcggaggttacgttattgccggaaggcttgcaccatggctgcttcgtgccgcagctagggtagcccctttccctttcgaggatgtctatacaggcttgtgtataagggcccttggcctggtgccacaggcccatccaggattcttgacagcatggcccgctgaccggacggccgatcactgtgcctttaggaatcttctcctggtacgtcctttgggccctcaggcctctatccgcctgtggaagcaactgcaggatcccaggctgcagtgctag

SEQ ID NO: 55768 - DNA, 1209 bp, Artificial Sequence
  Description of Artificial Sequence: Synthetic coding sequence
atgagacgcagacttcgccttcggagagatgctttgctcacactgcttctgggggctagtctggggctgctgctgtacgcgcaacgggacggggcagcacctaccgctagcgccccacgcggtaggggcagggccgcacctcgacctaccccaggacctagagcattccaactccctgatgccggagcagcccctcctgcctatgagggcgacaccccagcccctcccactcccactggccctttcgatttcgcaaggtacctgcgcgcaaaggatcagcgacgcttcccccttctgatcaatcagcctcacaagtgccgaggagatggagcgcctggtggcagaccagacctgctgatcgccgtcaagagtgtggccgaagacttcgagaggcggcaggccgttagacagacatggggcgcagaagggagagtgcagggtgcgctggtacggagggtcttcttgctaggagtcccacgtggcgcagggtctggcggtgcagatgaggttggggagggagcacgtacgcactggagggccctgctgagggccgagtccctcgcgtacgccgacattcttctctgggcattcgacgatacattctttaatttaaccctgaaggaaatccatttcctcgcctgggcgtcggccttctgccctgacgtccggttcgtgttcaagggggacgcagacgtgtttgtgaacgtgggaaatcttcttgaattccttgccccacgagaccccgctcaagacctacttgcaggagacgtcatcgtgcacgctcggccaatccgaacaagggcttctaagtattacatccccgaagccgtatacggtctgcctgcctatcctgcctacgcaggaggcggaggctttgttttgtctggtgccaccctccaccggttggccggagcatgcgcccaggttgagttgtttccaatcgatgatgtgtttcttggcatgtgcttacagcgcctgcgcctgacgccagagcctcaccctgcgttcagaacgttcgggattccccaaccatcagccgctccacacctgagcactttcgatccttgcttctaccgggagttggtcgtagtccatggactctcagccgctgatatttggttgatgtggcgcctactccatgggcctcacggaccagcttgtgctcatccccagccagtggccgcaggtccgtttcaatgggatagctag

SEQ ID NO: 55769 - DNA, 1584 bp, Artificial Sequence
  Description of Artificial Sequence: Synthetic coding sequence
atgaggtcggacaagagcgccttggtgttcctgctgctgcagctcttctgtgttggctgcggattctgtggaaaggttctcgtgtggccgtgcgatatgagccactggcttaacgtgaaagtaatactggaggagcttattgtccgcggacacgaggtgacagtgctgacacactcaaagccgtcccttattgactaccgcaagccaagcgccctgaaattcgaagtggtgcacatgcctcaggataggacggaggagaacgagatttttgtggatctggctctgaatgtgctcccaggactctcaacatggcagagcgttattaagctgaacgacttctttgttgagatccggggaaccctcaagatgatgtgtgagagctttatatacaatcagaccctaatgaagaaactccaggagactaactatgacgtgatgcttattgatcccgttatcccatgcggggatcttatggcagaactgcttgccgtccccttcgtgctgaccctgcgcatttctgtgggtggtaacatggaaaggtcttgcggcaaactgccagccccactgtcatacgtccctgtccctatgaccggcctcacggaccggatgaccttcctggaaagagttaagaatagcatgctcagcgtcctgttccacttttggatccaggactacgattaccacttttgggaggaattttattccaaagccctagggagaccaacaacattatgcgagactgtgggcaaggccgagatctggcttatccgcacctattgggacttcgagtttccccagccctatcagcccaattttgagtttgttggtggcctacattgtaaacccgcaaaggcactgcccaaagagatggaaaactttgtgcagagttcaggcgaggatggtatcgtggtgttctcgctgggttctttattccagaacgtgacagaggagaaagctaacatcatcgcatctgccctggcacagattccgcagaaagtgctgtggcggtacaagggcaagaaaccctcgacgctcggggcaaatacccggctatatgattggatcccccagaacgatctactcggtcacccaaaaactaaggcattcatcacccacggcggaatgaacggcatatatgaggctatctaccatggagtgccgatggtgggagtgcccatctttggggatcagctggacaatattgcccatatgaaagcaaagggcgctgccgtggaaataaacttcaaaaccatgacatccgaggacttactgcgtgcccttaggaccgtgattaccgactcttcttacaaagagaatgcaatgcggctgagccggatccaccacgaccaaccagtgaaacccctggatcgtgccgtcttctggatagaatttgtgatgcggcacaaaggagccaagcacctccgcagtgccgctcacgacctgacttggtttcagcattactcgatcgatgtgatcggattcctcctggcctgcgtcgctacagcaatcttcctctttaccaagtgcttcctcttcagctgtcagaaattcaataaaactcgaaagattgaaaagagggagtag

SEQ ID NO: 55770 - DNA, 717 bp, Artificial Sequence
  Description of Artificial Sequence: Synthetic coding sequence
atggaaaattttgtccagagcagcggggaggatggaatcgttgtattctcactgggaagcttgtttcaaaatgtaaccgaggagaaggccaatattatcgcttctgcgctcgctcagattccacagaaggtcctctggagatacaaaggcaaaaaaccatccaccctgggggctaataccaggctctatgattggatcccacagaatgatttactggggcaccctaaaactaaagcatttatcactcatggtggtatgaacgggatatacgaggccatttatcacggagtgcccatggtgggcgtgcctatcttcggggatcagctggacaacatagcccacatgaaagcaaaaggcgcagccgtggaaattaattttaagactatgacaagtgaggaccttctgagggccttacgcacagtcatcactgactcgtcctacaaggagaatgctatgagattgtctcgcatacaccatgaccagcccgttaaacctctggaccgagcagttttctggatcgagttcgtaatgcgacataagggcgctaagcatctgaggtcagccgcacatgacttaacttggttccagcattacagtattgacgtgatcggcttcctccttgcctgcgtggctactgccatctttctcttcactaagtgtttcctattctcctgccagaaattcaacaagaccaggaagatcgaaaagagggagtag

SEQ ID NO: 55771 - DNA, 1587 bp, Artificial Sequence
  Description of Artificial Sequence: Synthetic coding sequence
atggctctgaaatggacgactgtgctcttgatccaactgagtttctacttctcaagtggctcatgcggtaaggtgctggtgtgggccgctgagtactcactctggatgaacatgaaaacgatcttgaaagaattagtgcagaggggccatgaggtgacagtgctggccagcagcgcctccattctctttgaccctaacgattcctccacactgaaactggaagtgtacccaacgagcctgacaaaaaccgagttcgagaacattatcatgcagctggttaagcgactatcagaaattcagaaagacaccttttggttgccattctctcaagagcaggaaatcctgtgggccatcaacgatatcatccgcaacttttgcaaagacgtggtgagcaataagaagctgatgaagaagctgcaggaatctcgatttgatatcgtatttgcagatgcatacctgccatgtggcgaattgctggccgagttgtttaacatacccttcgtgtattctcactccttctcgcccggatacagctttgaacgccactcgggagggttcattttcccaccaagctacgttccagtagtgatgtctaaactcagcgatcaaatgacattcatggagcgagtgaagaacatgttatatgtgctgtacttcgatttttggttccagatcttcaatatgaaaaaatgggatcagttctattcagaggtgctcggcaggccaacaaccttgtccgaaacaatgcggaaggcagatatctggctcatgcggaacagttggaacttcaagttcccccacccttttctgcccaacgtcgatttcgtgggcggacttcactgtaaaccagcaaagccactgcccaaggaaatggaagaattcgttcagagcagtggcgagaatggggttgtcgtgttttctctcggaagtatggtgtccaatatgaccgaggaacgcgctaatgtaatcgccaccgccctggctaagattccacaaaaggtgctctggcggtttgatggaaacaaacccgatgcactcggcctgaacacaaggctgtataagtggattccgcagaacgatctgctcggtcatcctaaaactcgggcattcattacccatggaggcgcaaatgggatttacgaggctatttatcacggcatccccatggtaggaattccactgttcttcgatcaacccgataatatcgcgcatatgaaagcaaagggggctgccgtccgcgtcgacttcaatactatgagttctactgacctcctcaatgcccttaagacagtcatcaacgatcctagctataaggagaatattatgaagcttagcagaatccagcatgatcaaccagtgaagccgcttgatcgggctgtgttttggatcgaatttgtgatgcgccacaagggtgcaaaacaccttcgagtcgccgcacataatctgacttggtttcagtatcacagcctggacgtgattggatttctgctggcatgtgtggccaccgtcttgttcattatcaccaaatgctgcctcttctgcttttggaagttcgctagaaaaggcaaaaagggtaaacgtgactag

SEQ ID NO: 55772 - DNA, 1827 bp, Artificial Sequence
  Description of Artificial Sequence: Synthetic coding sequence
atgggatccgtcacggttaggtatttttgctatgggtgcctctttacgtccgcgacctggacagttcttttgtttgtgtactttaacttcagtgaggtgacccagccgctaaagaatgtcccagtgaaaggttctggccctcacggccctagccccaagaagttctaccccaggtttacaaggggccctagtcgcgtcctggagcctcagtttaaagcgaacaagatcgacgacgtaatcgattcccgcgtggaggaccctgaggaggggcacctgaagttttctagtgagctcggaatgatcttcaacgaacgcgaccaggagctgcgtgatttgggctatcagaagcatgcctttaatatgcttatctcagacaggctgggataccatagggacgtccctgacacaaggaacgcagcatgcaaggagaaattttacccacccgatcttccggctgcgagcgtagttatttgtttttataacgaggccttctcagcactactgaggaccgttcactcagttatagaccggactccagcccatttactgcacgaaattatcctagtggacgatgatagcgactttgatgacctgaagggtgaactggatgagtacgtgcaaaagtacctgccaggcaagatcaaggttatccgcaataccaaaagggaaggactaatccggggacggatgattggggctgcgcatgcaactggagaggtcctggtgtttctggacagtcactgtgaagtcaatgtaatgtggttgcaaccgcttctggcggcaatcagggaggaccggcacactgtggtgtgtccagtcatagatattatctccgccgatacactggcttatagcagttccccagttgtcagaggcggatttaactggggccttcatttcaagtgggatctggttccattaagcgaactggggagggccgagggagcgacagcaccaattaagagcccaactatggcaggtggtttgttcgccatgaataggcagtacttccacgagctaggccagtacgatagcggaatggatatctggggcggtgagaacctggaaatcagtttccgcatctggatgtgtggaggaaagctttttatcattccctgctcgcgggtgggacatattttccgcaagcggcgtccctacggcagtccagagggacaagacacaatgacgcacaattctctcagactggcccatgtgtggcttgatgagtacaaggaacaatatttcagcctgcgaccggacctgaagacaaaatcttatggcaatatcagtgagagggttgagctgcggaaaaaacttggctgtaagagtttcaagtggtacctggacaatgtgtatccagagatgcagattagcggaagtcacgcgaaaccccagcagcccatcttcgttaaccgcggacccaaacggccaaaggtattgcagcggggacggctgtatcatctccaaactaataaatgtttggtggctcagggacggccttcccagaagggcggattagtcgtgctcaaggcctgcgactactcagatccgaaccagatttggatctacaacgaggagcatgaactcgtcctcaattcattgctgtgcctggatatgagtgaaactcggtcctccgatccaccaagactgatgaaatgccacggaagcggcggttcacagcagtggacattcggtaaaaacaaccgtctgtaccaggtgtccgtaggccaatgtctgagggcagtagatcccctcggacagaagggctccgtggccatggcaatttgtgacggttcttcctcccaacagtggcatctggaagggtag

SEQ ID NO: 55773 - DNA, 609 bp, Artificial Sequence
  Description of Artificial Sequence: Synthetic coding sequence
atgggaagtgttaccgtccgttacttctgttacggctgtctgttcacctcagcaacttggactgtgcttttgtttgtgtatttcaacttctcggaggtaacccagccgcttaagaacgtgcctgtaaagggctcaggaccccatggcccaagtccaaaaaaattttatccacgctttacccggggtccatcccgggtcctggaaccacagttcaaggctaataaaatcgatgacgttattgatagcagggttgaggatcctgaagagggccacctgaaattttccagcgagctgggcatgattttcaacgagcgggaccaggaactcagggacttgggttaccagaaacacgctttcaacatgttgatatctgatcgattggggtatcatcgggatgtccccgacacccggaatgctgcctgcaaggaaaaattctaccccccagatctacctgccgcatcagttgtgatttgcttctataacgaggcgttctctgcactgttacggaccgtgcactccgttatagataggacacctgcccacctgctgcacgagataattcttgttgacgacgattctgacttcggcaaggagtgctgcacttggtag

SEQ ID NO: 55774 - DNA, 561 bp, Artificial Sequence
  Description of Artificial Sequence: Synthetic coding sequence
atgggcagcgtcaccgtaagatacttttgctacgggtgcctttttacatcagctacatggactgtcctgctgttcgtgtacttcaacttctcagaggtcacccagcctcttaagaatgtgcctgtgaagggaagtgggcctcacggaccttcacccaagaaattctaccctagattcactcgcggacctagtcgggtcctggagcctcaattcaaggccaacaagattgacgatgtgatagacagcagggttgaggatcccgaagaagggcatctgaaattttcctctgaactcggcatgatttttaacgaacgagaccaggagctccgggatctgggctaccagaagcacgcattcaatatgctgattagtgacaggttggggtaccacagagacgtcccagatacacgtaacgcagcctgtaaggaaaaattctacccgccagacctgcctgccgcttcggtggtaatctgtttctacaatgaggccttcagcgctttgctgcgtacggtacatagcgttatcgacagaacccccgcacatcttcttcatgaaatctag

SEQ ID NO: 55775 - DNA, 402 bp, Artificial Sequence
  Description of Artificial Sequence: Synthetic coding sequence
atggggtcagtcactgtgcgctatttctgctacgggtgcctgtttacctctgcaacttggactgtgcttctgttcgtgtatttcaatttcagcgaagtgacccagcccctgaaaaatgtcccagtgaaaggatccggtccacacggcccttctcccaagaagttctaccctcgattcacccgtggaccgagccgtgtacttgagcctcagtttaaggccaataagatcgacgacgtgatcgacagtcgagttgaggatcctgaagaagggcacctgaaattttcttccgagctagacgtaaaaaagagctcgacccatctgacatgccagctgctcgtgctcctgtccgtgagtatcatgaagcgctttctcccatgcttcgggcagtgcaccgtcagctag

SEQ ID NO: 55776 - DNA, 1827 bp, Artificial Sequence
  Description of Artificial Sequence: Synthetic coding sequence
atgggctcggtgaccgtccgctacttctgctatgggtgcttgtttaccagtgccacatggaccgtgctgttgtttgtgtatttcaattttagcgaggtcacacaacctttgaaaaacgtgcctgtgaaaggaagcgggccacacggcccttcccccaaaaaattttaccctcggtttacccggggaccgtcccgcgttctggagccccagttcaaggcaaataagatagatgacgtgattgattccagggtcgaagatcctgaagagggccatctgaagttctctagcgaattaggcatgattttcaatgagagagatcaagaactgcgggaccttggctaccaaaagcacgcattcaacatgctgatcagcgatagactgggttaccatagagatgtgcccgataccagaaatgcggcttgtaaagagaagttctacccacctgacctgccagcggctagcgtggtgatttgcttttacaatgaggcattttcagcactcctgagaacagtccacagtgttattgatcgcacgccggctcatctcctccatgaaatcatcctcgtggacgacgactctgatttcgacgatttgaagggagaacttgatgaatatgttcagaaatacctgcctgggaaaataaaagtgataaggaacaccaaaagagaggggttaatccgcggacgaatgataggcgctgcacatgccaccggagaagtgctggtgttcctggattctcactgtgaagtgaacgtgatgtggctgcaacccctgttggccgctatcagagaggatcgacataccgtagtctgccccgttattgacataatctccgccgataccctggcctacagtagctctccagtagttcggggaggatttaattggggactgcatttcaagtgggatctggtccccctctctgaactagggagggctgaaggcgcaaccgcaccaatcaaatccccaaccatggccggaggattattcgcaatgaatcggcagtattttcacgaattgggccagtacgattcaggaatggacatttggggaggagagaacttagagatcagtttccggatttggatgtgtggcggtaagcttttcatcatcccgtgctcccgcgtaggacatattttcaggaagagacgtccgtacggctcaccagagggacaggatactatgacacataattcacttagactcgcacacgtatggctcgatgagtataaagaacaatacttctctctgagacccgaccttaagacaaaaagctacggcaatatttcagaacgtgtcgagctgcggaaaaagcttggctgcaaaagcttcaagtggtaccttgataacgtgtacccagaaatgcaaataagcgggagccatgctaagccacagcagcctattttcgtaaacagaggacccaagagaccaaaggttctgcagagaggaaggctgtaccatctacagactaataagtgtctggtggctcagggacgaccttcccaaaaagggggtctagtggtattaaaagcatgtgattatagcgatcctaatcagatttggatttataatgaggagcatgagctggtgcttaattccctgctatgtctggacatgtccgagaccaggtcttccgatcctcccagactcatgaaatgccatggttctgggggttctcaacagtggacatttgggaaaaataacagactgtaccaggtaagtgtgggccagtgtctgcgggctgtcgaccctctgggccagaagggatctgtggcaatggcgatttgtgacggttcgagctcacagcagtggcacttggaagggtag

SEQ ID NO: 55777 - DNA, 297 bp, Artificial Sequence
  Description of Artificial Sequence: Synthetic coding sequence
atggggagcgtaacagttagatatttttgctacggatgcctctttactagtgcaacttggacagtgctcctgtttgtgtactttaatttcagcgaagttacgcagcccctcaaaaacgtcccagtgaagggctcaggcccacatggtccatcccctaagaagttctatcccagatttacgaggggcccttcccgggtccttgagcctcagtttaaagctaacaagattgatgacgtgattgattcaagagttgaggacccagaagaggggcatctgaaattctccagtgagctctag

SEQ ID NO: 55778 - DNA, 1827 bp, Artificial Sequence
  Description of Artificial Sequence: Synthetic coding sequence
atgggtagcgtaaccgtgagatatttttgctatggctgcttgtttacctccgctacatggactgtccttttgtttgtttatttcaacttctctgaggttacacagccactgaagaatgtgccggtgaaaggttcaggccctcacggccctagtcccaagaagttctatccgcgatttacaagggggccaagccgcgtgttagagccgcaattcaaagctaataaaattgacgatgtaatcgatagtagagtggaggatcccgaggagggacaccttaagttcagttccgagttgggaatgatcttcaacgagcgagatcaggagctgagggatctcggttatcagaaacatgcatttaacatgttaatttctgacagattgggctaccacagagacgtgcctgatacaaggaacgccgcttgcaaagagaaattctacccccctgacctaccagcagcctctgtagttatctgtttttacaacgaggcattctccgccctgctgagaaccgtgcactctgtgattgatcgtaccccagcccatctcctgcacgaaatcatcctcgtcgacgatgactccgatttcgatgacctgaaaggggagctggatgagtatgtgcaaaagtacttgccaggaaagattaaagtgatcagaaatactaagagggaggggctgatacggggaagaatgattggcgctgctcatgctaccggcgaagtgctggtcttcttggatagtcattgtgaagtaaatgtcatgtggctccagccactgttggcagccatacgggaagacagacatactgtcgtgtgtcctgtgatagatatcatttcagcggacaccttggcatattcctcaagccctgtggtaagagggggatttaactgggggctgcatttcaagtgggacctggtgccactcagcgagttgggcagagctgaaggcgcaacggctccaataaaaagccccacaatggccggaggcctcttcgctatgaatcggcagtattttcatgagctgggccagtatgactccgggatggacatttgggggggtgagaatctcgagatctcgtttcgcatctggatgtgtgggggtaaattgtttatcattccctgctcccgggttggccatatatttcgcaagagaagaccatacggatcaccggaagggcaagacacaatgacacacaattcactgcggctcgcacacgtctggcttgacgagtacaaagagcagtatttcagcctccgtcccgatttgaagaccaaatcttacggcaacatttctgaacgggtcgagctgcgaaaaaaactcgggtgtaagtctttcaagtggtacctggataatgtgtacccggaaatgcagatctccgggtcccacgccaaacctcagcaacctattttcgtaaacagaggcccaaagcgccctaaggtgcttcagagagggaggctctaccacttacaaaccaacaagtgcctggtggcgcagggcaggccttcccagaaaggcggactggtggtgctcaaggcctgtgactacagcgacccaaatcagatatggatttacaacgaggagcatgagctggttcttaattcattactgtgcctggacatgtctgagactcgctcgagcgatcctccccgacttatgaaatgccatggctcaggaggaagtcagcagtggaccttcgggaaaaacaatcggctgtatcaggtgtcagtcggacaatgccttagagctgtagacccgctgggacagaagggctcagttgccatggcgatctgtgacggctcttcaagccagcagtggcatctggaaggatag

SEQ ID NO: 55779 - DNA, 1827 bp, Artificial Sequence
  Description of Artificial Sequence: Synthetic coding sequence
atggggtctgtgacagtcagatatttttgctatgggtgcctgttcacctccgcaacatggaccgtgttattgtttgtgtacttcaatttcagcgaggtgacccagccccttaaaaacgtcccagttaaaggaagcggccctcacggcccaagccctaaaaaattctatccgagatttacacgcggtcctagtagggtgctagagccccagttcaaggctaacaagattgatgacgtgatcgactccagagtagaagaccctgaggagggtcacctgaagttctcatccgaactcggaatgatcttcaacgagcgcgaccaagaacttcgggaccttgggtaccaaaagcacgctttcaatatgctcatctctgacagactggggtaccatagagatgtcccagataccagaaatgccgcttgcaaggagaagttttatcccccagacctacctgccgctagtgtagtgatctgtttctataatgaagcattctcagctcttcttaggacagtccattctgttatcgacaggacccctgcccatctcttgcacgaaattatcctagttgacgacgattctgacttcgacgatctgaagggtgagctggacgaatatgtgcagaagtacctgcccggaaagattaaagtgatacggaatactaaaagagagggcttgatccgcggtcggatgatcggcgctgcccacgctaccggcgaagttttggtgtttctggatagccattgtgaggtgaatgttatgtggctgcagcctctgttagcagcaataagagaggaccggcacactgtagtgtgtcccgtgattgatatcatttcagctgataccttagcctattcatcctcacctgttgtgcggggtggctttaactgggggttgcatttcaagtgggatctggttccactgagcgagttgggacgtgccgagggagccacagcacctattaaaagtccaacaatggcagggggattgttcgcaatgaatcgccagtatttccatgagctgggccagtacgattctggtatggatatatgggggggagaaaacctggaaatctccttccgcatttggatgtgcggcggaaagctgttcatcataccatgctcccgcgttggacatattttccggaagcgcagaccttatggtagtcctgaggggcaggacactatgacccataactcattgcgcctggcccatgtatggcttgacgagtacaaagaacaatacttttcgctccggccagatttgaaaaccaagagttatggaaacataagcgaaagggtcgagctccgtaaaaagctgggctgtaagagcttcaaatggtatttggacaacgtctacccagagatgcagatcagtggctcacacgctaagccgcagcagccaatctttgtcaacagagggccaaaaagacccaaggtgctgcagagagggcgtctctaccacctgcagaccaacaaatgtcttgtcgcccaaggtcgacccagtcagaagggcggtcttgtggtgttgaaagcatgtgattattctgaccccaaccagatatggatctacaacgaagagcatgagctggtcctgaactcactcctctgcctggacatgagtgaaacccgcagcagcgatcctccgaggcttatgaaatgtcacggcagtgggggatctcagcaatggacattcggaaaaaataacaggttataccaagtgagtgttggccaatgcctgcgggcagtcgatcctctgggacagaaagggtcggtcgctatggccatttgcgacggatcctccagtcaacagtggcatctcgaaggatag

SEQ ID NO: 55780 - DNA, 483 bp, Artificial Sequence
  Description of Artificial Sequence: Synthetic coding sequence
atggggagtgttactgtcagatatttttgttacggatgccttttcactagtgctacttggacagtcctgttgtttgtatatttcaatttttcagaagttacccagcctctgaagaacgtgcccgtgaagggaagtggacctcatggtccatctcctaaaaaattctatccaaggttcacgcggggaccttcacgggtactggagcctcagttcaaagctaacaaaattgacgacgtaattgatagccgcgtggaagatcccgaagagggtcatctgaaatttagtagtgaattggggatgatcttcaacgagcgggatcaggaactgagagatcttggctaccagaaacacgcgtttaacatgctaatctcagaccgcttgggttatcacagggatgttccagatacaaggaacgccgcttgcaaagagaagttctaccctcctgaccttccagctgcctctgtagtaatctgcttttactag

SEQ ID NO: 55781 - DNA, 1584 bp, Artificial Sequence
  Description of Artificial Sequence: Synthetic coding sequence
atgccccaacccgagtcccagaaggccgcaatattgggttgcgggcagggaggtatgattttcaacgagagggatcaggaactgcgcgatttgggttaccagaaacacgccttcaacatgctgatctctgaccgcctggggtatcaccgcgacgtgccagatacacgcaatgccgcatgtaaggaaaaattctatcctcctgatcttcctgcggcttctgtcgtaatatgcttctacaatgaggcattttccgcgctgctcaggaccgtgcattcagtcatcgacaggacacctgcacacttgttgcacgaaattatcctcgtagacgacgattctgatttcgacgatctgaagggtgagctcgatgagtatgtgcagaaatacctccccggtaaaattaaagtgatcaggaacaccaagcgggaggggctgatccggggtcggatgattggggctgcccatgcaaccggggaagttctcgtattcctggatagccattgcgaagtgaacgtgatgtggttacaaccactgctcgccgcaatacgtgaggatcgccacactgtcgtgtgcccggtgatagatatcatttctgccgacacactggcctattcttccagtcctgtggtgagaggtggctttaattgggggctccacttcaagtgggaccttgtgcccctctccgagcttgggagggcggagggcgcaacggccccaatcaaatccccaacgatggcgggtggactctttgcaatgaaccggcagtactttcatgagctaggacaatacgattccggtatggatatatggggcggtgagaatctggagatttccttccgaatctggatgtgcggaggtaagctttttatcataccctgcagtcgagttggtcatatcttccggaagcgtagaccctacggaagccccgaggggcaagacacaatgacacacaattcccttcgtttggcccatgtatggttggacgagtataaagagcaatatttctctctgcggccagatctgaagacaaagagctacggcaatatcagcgagagggtggagttgagaaagaaacttggctgtaagtcgtttaagtggtacctggataacgtctatccagagatgcaaatttccggtagccacgccaagccgcagcagcctattttcgtaaatcgcggaccgaagcgtcctaaggtgttgcagagaggacgcttatatcacctgcagacaaataaatgtctggtggcgcagggacgtccatcacagaagggtggactggtagtcctcaaggcctgcgattatagcgaccctaatcagatctggatctacaacgaggagcacgaactggtgcttaattccctcttgtgcctcgatatgtccgaaaccaggtcctcggacccccctagactaatgaaatgtcatggctcaggaggatcacagcagtggacttttggtaaaaacaatcggctgtaccaggtcagcgtgggccaatgcctgcgagccgttgacccgctgggccagaaagggtccgtcgccatggctatttgtgacggctcttcttcccaacagtggcacctcgaagggtag

SEQ ID NO: 55782 - DNA, 2823 bp, Artificial Sequence
  Description of Artificial Sequence: Synthetic coding sequence
atgaatcggatccgtaaattcttccggggatcaggtagagtgctggcctttatcttcgtggcaagtgtaatatggctgctcttcgacatggccgctttaagactgtcatttagcgaaatcaacactagagttataaaggaagacatagtgcgacgagagcgtattggcttccgagtgcagcccgatcaggggaagatcttctatagctccatcaaggaaatgaagccgcctctacggggtcacgggaaaggcgcatggggaaaagagaatgtgagaaaaacagaagagagcgtgctgaaagtcgaagtagatttagatcagactcagcgcgagcggaaaatgcagaatgcactcggacgcggaaaagtagtgccactgtggcaccctgcgcacctgcagaccctacctgtaacacccaacaaacagaaaaccgatggtcgcggaacaaaacccgaagcttcatcccaccaaggcacacctaagcaaacgacggcccaaggggcacccaagaccagcttcatcgcagcaaaaggtacacaggtggtgaagatcagtgttcatatgggaagggtgagcctaaaacaggaaccacgaaagtctcactctccctccagtgacacaagcaagcttgccgcagagagagacttgaatgttactatttccctttctacagaccgcccaaagcagagatcccaagctgtggcaaatgagcgcgcacatccagctagcacagccgttccgaagtccggagaggcgatggctctgaacaaaacaaagacccagtccaaggaggtgaacgctaacaagcacaaggctaacacgagtctgccatttcctaagttcaccgtcaacagtaatcgactgcgcaagcagtctatcaatgaaactcccttgggcagcctgtcaaaggacgatggggcaaggggggcacacggaaagaaacttaacttctcagagtcccacctagtgattataacgaaggaagaggaacagaaggcagatcccaaggaggtgagtaattccaaaaccaaaaccatcttccccaaagtgctgggcaagtcgcagagcaagcacatttctaggaaccgcagcgaaatgtcttcgtcctccctggccccacacagggtcccgctctcacagaccaatcacgcccttaccggagggctggaacctgctaaaatcaatatcactgcaaaggccccatccaccgaatacaatcagtcgcacatcaaggctttgctccccgaggactcgggtactcaccaggtgttaagaatcgatgttactcttagccctcgcgacccgaaagcacccggtcaattcggcaggccagtggttgttccacacgggaaggagaaggaagcagagcgtcgatggaaggaaggcaatttcaacgtgtacctaagcgatttgatccctgtggacagggccatcgaagataccagacctgccggttgcgcggagcagctggtccacaacaatctccctacaacgtcagtcatcatgtgtttcgtggacgaagtgtggtccactcttctgcgttccgtgcattctgtcatcaaccggagcccccctcacctcataaaagaaatcctgctcgtggacgatttcagcacaaaggactatttaaaagataatctggataagtatatgtctcagttccctaaagtcaggatactacgccttaaagagagacacggtctcatcagggcccgtcttgcgggagctcaaaacgcgacaggcgacgtgctgacctttctggattcacatgttgaatgtaacgtagggtggctcgagcctctgctggaacgagtgtacctttcaaggaaaaaggtggcttgcccagttatagaggtgattaacgacaaggatatgtcttacatgacagtggacaatttccaacgcggtatttttgtttggccaatgaatttcgggtggagaacaattcctcccgacgtaattgcaaaaaatcgcataaaagagaccgacaccattcggtgtcccgttatggctggagggctgttcagtatagacaaatcctatttctttgaacttggcacttacgaccctggccttgatgtgtggggtggagaaaacatggagttatcatttaaggtttggatgtgcggaggtgaaatcgagataataccctgcagccgagtcgggcacatcttccggaacgataatccctattcattccccaaggatcggatgaagaccgtggagcggaacctggtcagagtcgcagaagtctggttggacgaatataaggagctattctacggtcatggagatcacctcatagaccagggccttgatgtgggtaacctcacccaacagcgggagttgcgcaagaagctcaagtgcaaatcattcaaatggtacctggagaatgtttttccagaccttagagcccctatcgttagagcgagcggcgtcctgatcaacgttgccttaggcaagtgcatatcaatagagaacactactgtgatacttgaggactgtgacggttcaaaagaactccagcaatttaactatacttggcttaggctgatcaagtgcggggaatggtgcatcgcacctattcccgacaagggagcggtccgcctgcatccatgtgataaccggaataagggcttgaagtggttgcacaagagcacatcggtgttccaccccgagttggtaaaccatattgtgttcgagaataaccagcagctgttgtgcctggaggggaacttttcacagaagatactgaaggtcgctgcctgtgatccagtgaagccgtaccagaaatggaagttcgaaaaatattacgaagcatag

SEQ ID NO: 55783 - DNA, 1677 bp, Artificial Sequence
  Description of Artificial Sequence: Synthetic coding sequence
atgcgcaaaattagagcaaatgccattgctatcctgacagtggcctggatcctgggtaccttctactatctgtggcaggataatagggcccacgctgcctcaagcggaggtcgaggcgctcagcgcgcaggaaggcgatcagaacagttaagggaggatcgcaccattcctctaatagtgactggaactccaagcaaagggtttgatgaaaaagcatatttaagtgccaagcagctgaaagccggagaagacccttaccgccagcacgcgttcaaccaactggagagcgacaagctgtcaccagatcgtcccatccgagacaccagacattactcgtgtccatcagtctcgtacagcagcgacctcccagcgacatccgtaatcatcacgtttcataatgaagctcggagtacacttctgcgcacagtgaaatcagtattgaatcgcactcctgccaacctgatccaagaaattatccttgttgatgatttttcttcggaccccgaggattgcttgctgcttactcgcataccgaaggtgaaatgcttaaggaacgatcgtcgggagggcctgattcggtctagggtccgaggagctgacgtagcagccgctaccgtgctgacattcctagacagtcattgcgaggttaacaccgaatggcttcctccaatgctccagcgcgtgaaggaagaccatacacgagtggtgtcaccaattatcgacgtaatctcacttgataactttgcctatctggcagcgtcggctgacctccggggagggttcgactggtctctgcatttcaaatgggaacagatcccactcgagcagaagatgacccggaccgatcccactaggcctataagaactccagtgattgctggagggatcttcgttatcgacaagtcatggtttaatcacttaggcaagtacgacgcacaaatggatatatggggcggagagaatttcgagctgagcttcagagtgtggatgtgtgggggatctctggaaatcgttccttgtagtcgagttggacacgtgtttaggaaacgtcacccttacaactttcctgagggaaacgcccttacctacatccgtaacaccaagcgcaccgcagaggtctggatggacgaatacaagcaatactactatgaagccagacctagcgccatcggtaaggccttcggtagtgtggctacaagaattgaacagcggaagaaaatgaactgcaagagtttccggtggtatctggaaaacgtgtatcccgaattgaccgtacctgtgaaggaggccttaccaggaatcattaagcagggcgtgaactgcctggagtctcaaggccagaacacagccggtgatttcctgctaggcatgggcatctgcaggggatctgccaagaacccacagcctgctcaggcatggcttttctcagatcatctgattcagcagcaggggaagtgtctggcagcgacctccactttgatgagttctccgggatctcctgtcatcctccagatgtgcaaccctcgcgagggaaaacaaaagtggagaaggaaaggctcatttattcaacacagcgtgtcaggactgtgtttagagactaagcctgctcaactggttacctctaagtgccaggccgacgcccaagcccaacagtggcagctcctgccccacacctag

SEQ ID NO: 55784 - DNA, 1677 bp, Artificial Sequence
  Description of Artificial Sequence: Synthetic coding sequence
atgcgaaaaatcagagcaaatgccatagcaatactcactgtcgcttggatcctcgggacattctactatctgtggcaagataaccgggcacatgctgctagctccggaggcaggggcgcacagagagctgggagaagaagcgagcagctgcgggaggaccgcacaatccctcttatcgtgaccgggactccctccaaagggttcgacgaaaaggcgtacctgtcagccaagcagcttaaagccggagaagacccctatcggcagcacgcattcaatcagctcgagagcgacaagttaagccccgataggcccatccgtgatactaggcactactcctgtcccagcgtgtcctatagtagtgatcttccagctacttctgtaattataactttccataacgaagcccgtagcaccctgttacgtactgtgaaaagtgttttgaacagaaccccagctaatttgattcaggagatcatcctggtcgacgatttctctagtgaccctgaggattgtctgctgctgacgcgtattcctaaagttaaatgtctgaggaacgatagaagagaggggttgatccgttcgcgagtccgtggagccgacgtggcagctgcgactgtgttaacctttctggactcccactgtgaggtcaatacagaatggcttccaccaatgctacagagagtgaaagaggaccatacccgcgtggtgagtcctattatcgacgttattagtcttgacaatttcgcttacctggctgccagcgctgacctgagaggtggtttcgactggagtctgcactttaagtgggagcagatacccctggagcagaagatgacaaggaccgacccaacgcgtccaatccgcacccctgtcattgccggaggtatttttgtgattgataagtcttggttcaaccacctcgggaagtatgatgcacagatggacatctggggtggcgaaaacttcgaactgtcattcagggtgtggatgtgcgggggttcccttgagattgtcccatgctcccgtgtggggcatgtgtttaggaagcgccatccctacaacttcccagaaggaaacgccctaacctatatccggaacacaaagcgaacagcagaggtatggatggatgaatacaaacagtactactacgaggccaggccctccgctattggcaaggcgttcggatcagtcgctacccgcattgaacagaggaagaaaatgaactgtaagtccttccgctggtacctcgagaacgtataccccgaattgacagttccagtgaaggaagctttacctggaataatcaaacagggtgtgaattgtctagagtcccaaggccagaacaccgccggtgacttcttgctgggcatgggtatatgcagaggttcagcaaagaacccccagccggctcaggcctggcttttctccgaccatctgatccagcaacagggcaagtgcctcgctgctacctccacattgatgtcttctcccggatccccggtgattttgcagatgtgcaacccgagggagggcaaacaaaaatggagacgcaaagggagctttatccagcatagcgttagcggcttgtgcctggagacgaaacccgcacagctcgtgacatcaaagtgccaagccgacgcacaagcacagcagtggcagctcctgccgcacacatag

SEQ ID NO: 55785 - DNA, 555 bp, Artificial Sequence
  Description of Artificial Sequence: Synthetic coding sequence
atggatgaatataaacagtattattacgaggcaagaccttctgccattggcaaggcattcggctccgtcgctacaagaatcgagcagcggaagaagatgaactgcaaaagctttagatggtacctcgaaaacgtgtatcctgagttgacggttccagtaaaggaggcattgccaggcattattaaacagggggtgaattgtctggagagtcagggacagaataccgctggcgacttcctcctggggatgggaatttgtcgtgggtctgccaagaacccccaaccagcacaagcctggctgttttccgaccacctcatccagcagcagggcaagtgccttgccgctaccagcaccttgatgtcaagcccaggttcacctgtaatcctgcagatgtgtaatccacgcgagggtaaacagaagtggcgccgaaaggggtcatttatccagcactcagtgtctggcctctgtctcgagaccaagccagctcagttagtaacctcgaagtgccaggctgacgctcaagcccagcagtggcagttgttgccacatacctag

SEQ ID NO: 55786 - DNA, 1629 bp, Artificial Sequence
  Description of Artificial Sequence: Synthetic coding sequence
atgcggaaaatacgggcaaatgcaattgccattttgacagtggcctggattctgggcacgttctactacctctggcaggataaccgtgcccatgcggctagcagtggaggtcggggtgcccagagggcagggcgtaggtctgagcagcttcgggaggacagaaccatccctctcattgtcaccggcacgccttcaaagggatttgatgagaaggcctacctctccgctaagcagcttaaggccggtgaagacccttacaggcagcacgccttcaatcaactcgaatctgataaacttagtcctgaccgcccaattcgtgacactcggcactactcctgcccctcagtgagctactcgtctgatttgcccgcaacaagtgtgatcatcaccttccataatgaggcacgctccacccttctgagaacggtgaagagtgtcctgaaccggacacccgctaatcttatccaggagatcattcttgtggatgacttttcatccgatcctgaggattgccttcttctaacgcgcattccgaaggttaagtgcttgcggaatgatcgaagagagggattaatacggtcaagagtcaggggggctgacgtcgccgctgccacagtactgaccttcctggatagccactgcgaggtgaataccgagtggctgcctccgatgctgcaaagagtcaaagaggatcacacaagggtcgtgtcccctattatagacgtgatctctctcgacaacttcgcatatctggcagcctcagctgacctccggggtgggtttgattggtccttgcactttaaatgggaacagattccgctagaacaaaagatgaccaggacagatccgaccaggcctatacgaactcctgtaatcgccggtggtatttttgtgattgacaagagctggttcaaccacctggggaaatatgacgctcaaatggatatctggggtggagagaactttgagctgtccttcagagtatggatgtgtggcggatccctggaaattgtgccgtgtagccgagtaggccatgtctttagaaagcgtcacccttataacttcccagaggggaatgccttgacatacatccgcaacacaaagaggacggcggaggtgtggatggacgagtacaagcagtactactatgaggcccgtccatccgccatcggaaaggcatttggttcagtggctacgcgaatcgaacagcgaaagaaaatgaattgtaaaagtttccggtggtacctggagaatgtgtatcctgagttaaccgtccccgtgaaggaagcactgcccggaattatcaaacagggggttaattgcttggaatctcagggacaaaacaccgctggagattttctgttgggaatgggcatttgccgtggcagcgcaaagaaccctcagcccgcacaggcctggctctttagcgaccacttaatacaacagcaaggcaaatgtctggctgccaccagcaccttgatgagcagtccaggaagtccagtgattctccagatgtgcaacccccgagagggcaagcaggtcagtctgcttgccagcggccctgaggcgcagcagcccgagggaccctgcctgcgcgtggccgacttgggcagaagggcccctgactag

SEQ ID NO: 55787 - DNA, 1920 bp, Artificial Sequence
  Description of Artificial Sequence: Synthetic coding sequence
atgttgctgcgcaaacggtaccggcatcggccatgtcgtctacagtttctcctgctcttattaatgcttggctgtgtgctcatgatggtggccatgctgcacccccctcaccacactctccaccagaccgttaccgctcaggctagcaagcacagcccagaagccaggtatcgtcttgacttcggcgagagtcaggattgggtgctcgaggcggaggacgaaggcgaggagtactcccctttagagggtcttccaccgtttattagtcttagggaggaccagcttctggtagcagtagctctacctcaggctcgccgaaatcagtcccagggtcgcagggggggaagttaccgcctcataaaacagccaagacgccaggacaaagaagctcccaaaagggattggggggctgacgaggatggcgaggtgtctgaggaggaagaactcaccccatttagccttgatccgcgaggtctgcaggaggccctgtcagctcggattccgctgcagagagccctgcctgaggtaagacacccgctatgcctgcaacagcaccctcaggattctcttccaacggcgagtgtcatcttatgttttcacgacgaggcttggtcgacattgctgcggacggtacactccattctagacaccgttcctagagcttttctgaaagagataattctggttgatgatttatcacagcaaggccagctaaaaagcgccctgagcgaatacgttgccaggctggagggggttaaactactacggtctaacaaacgcctgggcgcaatacgcgctagaatgttgggcgcaacaagggcgacgggtgacgtcctggtgttcatggacgctcattgcgagtgccatccgggatggttggagccccttctgtcccggatagccggagataggagccgcgtggttagtcccgtgattgacgtcatcgattggaagacattccagtattaccccagcaaagaccttcagaggggagtcctggattggaaacttgattttcactgggaaccattaccggaacatgtcaggaaggcccttcagagtcccatttcacccatcagaagtcccgttgttccaggcgaagtggttgcaatggatcgtcactattttcagaatacaggcgcttatgattcactcatgtctctgaggggtggtgaaaacctcgagttgtcattcaaagcctggctctgcgggggatccgtggaaatattaccctgttcacgggtgggacacatttatcagaaccaggattcacacagtcctctggaccaggaggccacccttaggaatcgggtgaggattgccgaaacttggctgggtagtttcaaggagacgttctacaagcactccccagaagctttttccctgtcaaaggcagagaagccggattgcatggaaaggttacagctgcagcggcgacttggatgtagaacgttccattggtttctcgcgaatgtgtacccagagctatacccctcagagccaagacccagcttctcaggtaagctgcacaatactggtctgggtttgtgtgccgactgccaggctgaaggtgacatactcggctgcccaatggttttggccccttgctctgacagtagacagcaacaatatctccagcacacatcacgcaaggagatccacttcggtagcccccagcatctgtgcttcgccgtcagacaggaacaggtgatccttcagaactgcacggaagaaggtcttgctattcatcagcaacactgggatttccaggaaaatggaatgattgtgcacattctatccgggaaatgtatggaagccgttgtgcaggagaacaacaaggacttgtatctaagaccctgcgacgggaaggccaggcagcaatggcggtttgaccagatcaatgcagtagatgagcgctag

SEQ ID NO: 55788 - DNA, 591 bp, Artificial Sequence
  Description of Artificial Sequence: Synthetic coding sequence
atggaacgcttacagctccagagaaggctcggttgccgaactttccactggtttttggcaaacgtgtatccggagctgtatccaagtgaacccaggccttctttcagcggcaaactgcataatactggattaggcctgtgcgctgattgtcaggctgagggagatatcctcggctgccccatggtgttggcgccatgctccgactcaaggcagcagcaatacctccagcacacttcccgaaaggaaatccacttcggctctcctcagcatttatgtttcgctgtgcgtcaggagcaggtaatccttcaaaactgcacagaagaaggcctggccatacaccagcaacactgggattttcaggaaaacggaatgattgtacacatcttgagcggtaaatgcatggaagcggtcgttcaggagaataataaggacctgtacttgcggccatgcgatgaaaagcccgcaagcagcggcgtccttaccagaagcatgctctggatgaacgatgaatgccagtgtcagaaagaaaagcgaatcttagccatcaaaattcaactccaagtaaacctgaaatccttatatatctcatag

SEQ ID NO: 55789 - DNA, 1737 bp, Artificial Sequence
  Description of Artificial Sequence: Synthetic coding sequence
atgttgccttgcctcgttgtcctgctcgctgctctgctatcattgcgtctcggatcagacgctcacgggacagaactgcctagtccgccttccgtgtggttcgaggccgaattcttccaccatattctgcactggacgccgattcctaatcagagcgaaagtacctgctatgaagtagcacttctgcgctatggcattgaaagctggaactcaatctcaaattgttctcaaactctgtcctatgatctcaccgccgtcacccttgatctgtaccacagcaatgggtaccgagctcgcgtgcgcgcagtagacggctctcgccactccaactggaccgtgaccaataccagattttcagtggatgaagtgaccctgactgtgggctcggtcaacctcgagatccataacggcttcattctaggcaagattcagttacctcgcccaaagatggcacccgcaaatgacacctacgaaagcatcttctcccattttagggagtatgagattgcgatccgaaaggtacctggaaactttaccttcacacacaagaaggttaagcacgaaaatttctcattgttaacctcgggtgaagtgggcgagttctgtgtccaggtgaagccctccgttgcttcgcgaagcaacaagggtatgtggagcaaggaggagtgtatcagcttgactcgacagtactttacggtaaccaacgtcattattttttttgcctttgttctgctgctcagcggggctctcgcctactgtctggcactacaattgtatgtgaggcggcgtaaaaaactgccaagcgtgcttctatttaagaagccaagtccctttattttcatctctcagaggccttctccagaaacccaagacacgatccatcccttggacgaggaggccttcttgaaggttagccccgagctgaaaaacttggatttgcatggatcgacagacagtggtttcggctcaactaaaccctcccttcagaccgaggagccccagttcctgctccccgatccccatcctcaggctgatagaacgctcggcaacagggaaccaccggtgctgggcgactcatgctcttctggtagctctaactccactgactccgggatttgcttacaggagccaagcctttcgccctcaacgggtcctacttgggaacagcaggttggcagcaactcacgaggtcaggacgatagtggtatcgacctcgtccagaactccgagggcagagctggggatacgcagggaggttcggcattgggccatcactcccccccagaaccagaagttcctggggaggaggaccccgcagccgtagctttccagggatatcttcgccagacacgatgtgcagaggagaaggctacgaaaaccggctgcctggaggaggagtccccactgactgacggcctcggaccaaaattcggacgatgtctggtcgatgaagcaggacttcatccccctgctctagcaaagggctatttgaaacaagatcctctggagatgaccttagcaagttctggcgctccaacgggacagtggaaccaacccacagaggaatggagccttttggctttaagcagttgcagcgatttgggaatttctgattggagttttgcgcacgatcttgcccctctgggatgtgttgcagcgcctggaggcctgttggggagttttaacagcgaccttgtaactctgccattgatttcctctctccagtcctcagagtag

SEQ ID NO: 55790 - DNA, 1332 bp, Artificial Sequence
  Description of Artificial Sequence: Synthetic coding sequence
atgcgtaatgcgatcattcaaggcctgttttacggttcccttaccttcggcatttggaccgccctcctgttcatctatcttcaccataatcacgttagcagttggcagaaaaagtcccaggagcccctgtccgcctggagccctggcaaaaaggtccatcagcaaatcatttacggtagcgagcagattcccaaaccgcacgtgattgtgaagaggaccgacgaggataaggcaaaaagtatgttagggaccgatttcaaccacaccaatccagagttgcataaggaacttttgaagtacgggttcaacgttattatcagccgctcactgggaatcgagcgtgaggtgcctgatacacggtccaaaatgtgcctgcagaagcattaccctgccaggcttccaacggcctctatagtgatttgcttttacaatgaggagtgtaatgctctgtttcagaccatgtccagtgttactaacctgaccccacactattttctggaggaaatcattcttgtggacgatatgagcaaggtcgacgacctcaaggagaagctggattatcacttagagacattccgtgggaaagtcaagattattcgcaataagaagcgcgaggggcttataagagccaggttaattggggcatcacacgcgagcggggatgtgctcgtgtttctggactcacactgtgaagttaacagggtgtggctggaacccttgctccacgccatcgccaaggatcctaagatggtggtctgccccctgatagatgtgatcgacgacaggaccctagaatacaagccttccccactagtcaggggtactttcgactggaaccttcaatttaaatgggacaacgtgttttcttacgaaatggacggaccggaggggtccacgaaacctatccgcagtcctgctatgtccggtggcatcttcgctattagaagacattactttaacgaaattggacaatatgacaaggatatggacttttggggccgtgagaacttagaactgtctttgcggatttggatgtgtggagggcaattgtttatcataccgtgtagccgggtgggtcacatatccaagaagcagaccggaaagccttcgacaattatttctgcaatgactcataactacctcaggctggtgcatgtgtggcttgatgagtacaaggaacagttcttcctgaggaagcccggactgaaatacgtcacttatggcaacatccgtgaaagggtggagctgcgaaaacggctaggatgtaagagcttccagtggtacctagacaacgtgttcccagagctggaagccagcgttaatagtctctag

SEQ ID NO: 55791 - DNA, 1332 bp, Artificial Sequence
  Description of Artificial Sequence: Synthetic coding sequence
atgaggaatgctattatccagggcctcttttacggctctctgacattcggaatatggaccgcacttctgtttatctatctgcaccacaatcatgtgtctagttggcagaagaagtcccaggagccactgagcgcatggtctcccggaaagaaagtccaccagcagatcatttatggctctgagcagatccccaaaccgcacgtcatcgtgaagcgcactgacgaagacaaggcgaaaagtatgctgggcacagatttcaaccataccaaccctgagctgcataaagaactgctgaagtatggctttaacgtgataattagtcggtctctgggcatcgagagagaggttccagacacccggtctaagatgtgtctgcaaaagcactatccagccaggctgccaacagcaagcatcgtgatttgcttctacaatgaggaatgtaacgccctattccaaactatgtcctccgttacaaatttgaccccacattatttcttggaagaaataatcttagtagatgatatgtcaaaagtcgatgaccttaaagaaaaactggattaccacctagagacctttcgtggtaaggttaagattattcggaataaaaagcgggaaggtctaatcagagccagacttatcggtgcaagtcatgcctctggtgacgtcctggtctttttggactcccattgtgaagtaaaccgagtctggctcgagcccttgctgcacgctatagccaaggaccctaagatggtggtgtgccctctgattgacgtgattgacgacagaacgctcgagtacaaaccctcccccctggttagagggacatttgactggaatctccaattcaagtgggataacgtctttagttacgagatggacgggccagagggctctacgaaacctatcagaagccccgctatgtccggtgggatctttgctataagacgacattacttcaacgaaattggccagtacgataaggatatggacttttggggccgtgaaaatctcgaactgtcacttaggatctggatgtgtggtggccaattgttcatcattccatgctctagggttgggcacatctcaaagaagcagactgggaagccttccacaattatcagtgcgatgacccacaattatctgagattggtccatgtctggttggacgagtacaaggagcagttttttttgcgcaaacctggcttaaagtatgtcacatacggcaatatacgtgagagggttgagttgagaaaacgcttgggttgtaaaagcttccagtggtacctggataacgtcttcccggagcttgaggcttcggttaattctctttag

SEQ ID NO: 55792 - DNA, 681 bp, Artificial Sequence
  Description of Artificial Sequence: Synthetic coding sequence
atgaaaaggaagcagaaaaggtttctccagatgacactcctgtttacagtggccctcatcttcctccctaacgtcggactctggtctctgtacaaggacaaacacctcgttaagagcgctgagcccggagagcagcagacgttccctttgggactcggcgacggacagttttactcttggaccgacggccttagaagaaaggattggcacgattacgaatcgatccaaaaggaggctatgagaagtggtaaaggtgagcatggaaagccctacccgctcaccgaggaagaccacgatgacagcgcctatcgggaaaacggcttcaacattttcgtcagcaacaatatagctttggaaagatcgttgcccgacattcgccatgcaaattgtaaacataaaatgtatctcgagcgcctcccaaatactagtatcattatccctttccataacgaagggtggaccagccttctgaggaccattcattccattatcaaccgcacccccggatcgctaatagcagagatcatattggtggatgactttagcgaacgcgaacacttaaaagacaagctcgaggagtacatggccaggttcagcaaagtgcgtatcgttagaactaaaaaaagggaagggagcggccctgtgtcttggggccacctttggcccgaagaaaagtcctag

SEQ ID NO: 55793 - DNA, 1806 bp, Artificial Sequence
  Description of Artificial Sequence: Synthetic coding sequence
atgaaaagaaaacagaagagattcttgcagatgaccctgctgttcacagtggctctgatctttctgcccaatgtgggtctctggagcttatataaggacaagcatttagtcaagtcagctgagccaggcgagcagcaaaccttcccgctcggcctcggagatgggcaattctattcttggactgatgggttaaggcgcaaagattggcacgattacgaaagtattcaaaaggaggccatgcggtctggaaaaggcgagcatgggaaaccatacccgttaaccgaagaggaccacgatgactcagcttatagagagaatggattcaacattttcgtctctaataacatcgccctggagaggagccttcctgacataaggcatgcaaattgcaagcataagatgtacctggagaggcttcctaacacaagcatcattatcccctttcacaatgaaggttggacttccctgctgcgtacaattcatagcatcataaatcggaccccaggctcactgattgcagagataatcctggtggacgatttctcagagagagaacacttaaaagacaaattggaagagtacatggccaggttctcgaaggtgagaattgtgcggaccaaaaaaagagagggtctcattaggaccaggctcttaggagcctcaatggcgaggggcgaggtcctcacatttttggactcacattgtgaggttaacgtcaactggctacctcctcttttaaaccagatagcactaaatcacaaaactattgtctgcccaatgatagatgtcattgaccacaatcactttgggtatgaggcacaggctggagacgctatgcgcggagcatttgactgggagatgtattataaacgaattccaatcccccctgagctacagagagctgatccaagcgacccttttgagagccccgtaatggccggagggctatttgccgtcgatcgaaagtggttctgggaactggggggttatgatcctggccttgagatctggggtggagagcagtatgagatctcatttaaggtatggatgtgtggcggtgagatgtttgatgttccctgctcgagggtgggccatatctaccgaaagtatgttccttacaaagtccccagcggcacttccctggcacggaacttgaaaagagtagccgaaacctggatggacgagttcgcagagtacatttatcaaagaaggcccgagtaccgccatctcagcacaggcgatatctccgctcagaaagaattgaggaagcagctgaagtgcaaggactttaagtggttcatggccgctgtagcatgggatgttcccaaatactaccctcctgtcgaaccgcctcccgcagcatggggggaaatcagaaatgtggccgcaaacctctgcgtggacagtaagcatggtgcaacaggcacggaattacggctggacatctgtgtcaaagacggcagtgagaggacctggtcccacgagcagctgtttacctttggatggagggaggatatccgacctggggaaccactgcacacccggaaattttgcttcgatgccataagccacaatagccccgttacattgtatgactgccatgggatgaagggcaaccaactgtggggatatcggaaggaccgcacactcttccacccagtgagtaattcatgcatggattgtaacccagcggaaaagaagatctttatggcgaggtgcgatccattgtctgagacacagcaatggatttttgaacacatcaacatgaccgttctcgagaaattcaaccaccacgctaattcttag

SEQ ID NO: 55794 - DNA, 1569 bp, Artificial Sequence
  Description of Artificial Sequence: Synthetic coding sequence
atgaatataaatgacttgaaactgaccctgtccaaggcaggccaggagcatctgctgagattctggaatgagctggaggaggcacagcaagtggagctatatgccgagctgcaggcgatgaatttcgaggaactgaatttcttcttccagaaggctattgagggcttcaatcaatccagtcatcaaaagaacgtcgacgcacgtatggagccagtgcctcgagaagtgctgggatcagcaactagggatcaggaccagctacaggcttgggagtccgagggtctgttccaaatttcccagaataaagtggcagttctactccttgcgggaggccaggggacccgactgggggtggcctacccaaagggaatgtacgacgtcggtttacccagccgcaaaacactttttcaaatccaggcagagcgcatcctgaaactccagcaggtggcagaaaagtactatggcaataagtgtattatcccatggtacattatgacatcaggcaggaccatggagagtacaaaagagttcttcaccaaacataagtacttcgggctgaaaaaggagaatgtaatttttttccagcaagggatgctgccagcgatgtcgttcgatgggaagattattcttgaagaaaaaaataaggtgtccatggcccctgatggaaacggcggactctatagagctctcgccgcacagaacatcgttgaggacatggaacaacggggaatttggagcattcacgtgtactgtgtcgataacatactcgtcaaagtagctgaccccagattcatcggcttttgcatccaaaagggggctgattgcggagctaaggtggtcgaaaagactaatcccaccgagcccgtcggagtcgtgtgccgagttgatggagtgtatcaggtcgtcgagtatagtgaaatcagtctggccacagcgcagaagcggagtagtgacggcagactgctgttcaacgcaggcaacattgcgaaccattttttcactgtccctttcctcagggacgtggtgaacgtctacgaaccccagttgcaacaccatgttgcccagaaaaaaataccctacgttgatacacaaggccagctaatcaaacccgataagccaaacggaatcaagatggaaaagtttgtttttgatatttttcagtttgctaagaaattcgtcgtgtacgaagtgctgcgagaggacgaatttagtccgctcaagaatgctgatagtcagaatggcaaggacaaccctacaaccgcaaggcatgctctcatgtccctccaccactgttgggtgttgaatgcaggaggccatttcattgacgagaatgggtcacgactgcctgctattcccaggtccgccaccaatggaaagtctgaaaccattactgcagatgtcaatcacaatctgaaggatgcgaacgacgtcccaattcagtgtgagatatcacctctaatatcatacgccggagaggggctagagtcctatgtcgcagacaaggagtttcacgctcccctgatcatagatgagaacggagtccacgaactagtaaagaacgggatatag

SEQ ID NO: 55795 - DNA, 1566 bp, Artificial Sequence
  Description of Artificial Sequence: Synthetic coding sequence
atgaatatcaatgacctcaaacttaccctgagcaaagccggacaggaacatttgctgcgcttttggaacgaattggaagaagcccagcaagttgaactatacgctgaactccaggccatgaacttcgaggaactaaatttcttctttcagaaagctatagagggcttcaaccaatcttcgcatcaaaaaaatgtcgatgcaaggatggaacccgtgcctcgtgaagtcttgggaagtgctacgagggatcaggaccagctgcaggcctgggagagtgagggcctgttccagatcagccagaacaaggtggcggtgttgctgctggccggagggcagggaaccagactgggggtcgcttaccccaaaggaatgtacgatgttggactgcccagccggaagaccctgttccagatccaagccgaacgcatccttaagcttcaacaggtcgctgagaaatactacggaaataagtgtatcattccttggtacatcatgacctctggcagaaccatggagtccacgaaggaattcttcacaaaacataagtatttcgggctgaaaaaagagaacgttatcttctttcagcaaggtatgctgccggcaatgtcattcgatggaaagatcatccttgaagaaaaaaataaggtgtccatggccccagacggaaatggcggtctttatcgagccttagctgcacaaaacatcgtggaggatatggagcagcgcggtatatggtcaattcacgtttattgcgttgataatatcttggtcaaggtcgctgaccctagattcattggcttctgcatccagaagggagccgactgcggtgccaaagtggttgagaagaccaaccctaccgagccagtgggggtggtgtgtagggttgacggggtgtatcaagtggtggaatactccgagatctcacttgctacagcacagaagaggtcctccgacgggcgtctgctgtttaatgctgggaatatcgccaatcatttttttacagttccttttctgagagacgtcgtgaacgtgtacgaaccccaattacaacatcatgttgctcagaagaaaattccatacgtcgacacccaggggcagctgatcaagccagacaagccaaatggtattaagatggagaagttcgtatttgatatctttcagtttgctaagaaatttgttgtatatgaggtgttgcgggaagacgagttcagtcctttgaagaacgccgacagccaaaacggtaaggacaaccctaccacagctcgccatgccctgatgtcactccatcactgctgggtcttgaatgctggaggtcattttattgatgagaatgggtcaaggctgccggctatccctcgcgcaactaatggaaaatcagagacgataaccgccgacgtgaatcacaatctgaaagacgcaaatgacgtccctattcagtgtgaaatcagccctctcatttcctacgctggcgagggactggagagctacgtagccgacaaggagtttcatgcgcctctgatcatagatgaaaatggagtgcatgaacttgtaaagaatggcatctag

SEQ ID NO: 55796 - DNA, 1569 bp, Artificial Sequence
  Description of Artificial Sequence: Synthetic coding sequence
atgaacatcaacgatttaaaactgacattgtccaaagccggacaggagcatctactgcgcttttggaacgaacttgaggaagcacagcaggtagagctctacgcagaactccaagcaatgaattttgaggagctgaactttttctttcagaaggctatcgaaggattcaatcagtcatctcaccagaagaatgtggacgctagaatggagcccgtgcccagagaagtgttgggcagcgctaccagagatcaggatcagctccaggcatgggagtcggagggcctctttcagatttcacagaataaggtggcagtgctgctgttggcgggaggacagggcacccgattaggtgtggcttacccaaagggcatgtacgatgtcggattacctagtcggaagaccttgttccagatccaggcagagagaatcctgaagctgcaacaggtggccgagaaatactatggaaacaaatgcatcatcccatggtacatcatgacttccggcagaactatggaaagcaccaaggaattctttaccaagcacaagtacttcggactcaagaaggagaacgtgattttctttcagcagggcatgttaccagcgatgtctttcgacggcaagatcattttagaggagaaaaacaaggtgtcaatggccccagacgggaacggtggcctgtatcgggcactggccgcacagaatatcgttgaggacatggagcagcggggtatctggagcatacacgtgtattgcgtggacaatatcctggtgaaagttgctgatcctagattcatcgggttctgtatacagaagggagctgattgcggcgctaaagtggtcgagaagaccaatcccacagagcccgttggcgtcgtgtgccgtgtcgatggagtctatcaggtcgtggaatactccgagatcagtttggcgaccgctcagaagagatcctctgatggtcgcctgctcttcaacgctggcaatatcgctaaccattttttcacggtaccctttctgcgtgacgtagtaaatgtgtatgaaccacagctgcagcatcacgtggctcaaaagaagatcccctacgtggacactcagggtcagcttatcaagcctgataagcccaacggcattaagatggaaaagttcgtatttgacatttttcagttcgctaagaagtttgttgtctatgaagtgctgagagaagatgaattttcaccactgaagaacgccgacagccagaatggcaaagataaccccacgactgccagacacgccttaatgtctctgcatcattgctgggtgctgaatgcaggcggtcattttatcgacgagaatgggtcccgtctccctgctattccccgatcagctacgaatggcaagtctgaaactatcacagccgatgttaatcataatctaaaggatgcgaatgacgtgccaattcagtgtgagatttctcccctgatcagctacgcaggagagggcctcgagagctatgtcgcggacaaggagtttcacgcgccactgattattgacgagaatggagtgcatgaactcgtgaaaaacggcatctag

SEQ ID NO: 55797 - DNA, 1518 bp, Artificial Sequence
  Description of Artificial Sequence: Synthetic coding sequence
atgaacatcaacgatctgaagttgaccctatcaaaggcagggcaggagcatctgcttcgcttctggaatgagctggaggaagcacagcaagttgagctttacgcagagctgcaggctatgaactttgaggaactgaacttcttttttcagaaggccattgagggctttaaccagagctcgcaccagaaaaacgtggacgccaggatggaacccgtcccccgagaagtcctgggttccgctaccagagatcaggaccaactgcaggcatgggaatccgaggggctttttcagattagccagaacaaagttgcagtgcttcttcttgcagggggacaagggaccagactcggagtggcctacccaaaggggatgtacgacgtgggtctgccgtcacgcaaaaccctgtttcagatacaggccgaaagaatcctgaagctacagcaagtggccgagaagtattacgggaataagtgtataatcccatggtacataatgacctccgggcgtaccatggagagcactaaagagtttttcactaaacacaaatattttggcctgaagaaggagaacgtgatctttttccagcagggcatgctgcccgctatgtccttcgatggtaagataattcttgaggagaagaataaggtgagcatggcccctgatggcaatggtggtctgtatagggctctggccgctcaaaatattgtggaggacatggagcagaggggaatctggagtatccacgtgtattgtgtagacaacatactggtgaaggtagccgatcccagatttatcggtttttgcatccagaagggcgcagactgcggggcaaaagttgtggaaaagacaaatcccactgaacctgtcggtgtggtgtgcagagtagatggcgtgtatcaggtcgtcgagtattctgaaatcagtctcgcgacagctcagaaacgcagttctgacggaaggttgttattcaatgctggtaatatagccaaccacttttttacagtgccatttttaagagatgtcgtgaacgtctacgagcctcaactccaacatcatgtagctcagaagaagattccctacgtggatacacaaggacagcttataaaacctgataaacccaatgggatcaagatggagaaatttgtgttcgacatcttccaatttgccaagaagttcgtcgtgtacgaagtgctgcgggaggatgagttcagccccttaaaaaacgccgattctcagaatgggaaggacaacccaacaaccgccagacatgccctgatgtcactacatcactgttgggtcctgaatgccggaggtcactttattgacgagaatgggtctaggctgccagcaatcccacggctgaaggacgccaatgacgtccctatccagtgcgaaattagtccgctgatttcttatgccggagagggcctggagtcctacgtcgccgacaaggaatttcacgccccactgatcatcgacgagaatggcgtacatgaacttgtgaagaatggcatctag

SEQ ID NO: 55798 - DNA, 663 bp, Artificial Sequence
  Description of Artificial Sequence: Synthetic coding sequence
atgaacataaacgacctgaagctcacgctatctaaagcgggtcaggaacatcttctgcgcttttggaatgaactggaggaagcccagcaggtggagctgtacgccgaactccaagctatgaattttgaggaactcaattttttttttcaaaaggccattgaagggttcaaccagtcttcccaccagaaaaacgtagacgctcgcatggagcctgtgccacgcgaagtgctgggatcagcgactcgcgaccaggatcagcttcaggcctgggaatccgaaggcctgtttcagatatcccagaacaaggttgcagtcctgctgttggcaggcggacagggtacaaggttgggggtggcatatccgaagggtatgtacgacgtggggctgccatcccgtaagaccctctttcagattcaagcagagcgtatcctgaagttacagcaggtcgccgaaaagtattatggcaacaaatgcatcataccatggtacattatgacgtccggcaggaccatggagagcacaaaagaattctttaccaaacataagtactttggtctcaaaaaagaaaacgtgatcttcttccagcagggcatgttgccagccatgtcattcgatggtaagattatcttggaggagaagaataaggtctccatggccccttag

SEQ ID NO: 55799 - DNA, 4776 bp, Artificial Sequence
  Description of Artificial Sequence: Synthetic coding sequence
atgagtcttctgtgcgttagggttaagagggcaaagtttcaaggcagtccggataaattcaatacctatgtcaccctgaaggtccagaatgtgaaaagcacaaccgtggctgtgcgcggagatcagccttcctgggagcaagatttcatgtttgagatcagtaggctcgacctggggctgtccgtggaggtgtggaacaagggactgatatgggacactatggtagggactgtttggattgcgctcaagaccatccggcagagcgatgaggagggtcccggtgagtggtccaccctggaggctgagaccctgatgaaagatgacgagatttgcggaacacgcaaccctacaccccacaaaatcctcttagacaccaggttcgaattgccgttcgatatccctgaggaggaagcgcgatactggacatacaaatgggagcaaatcaatgctttgggcgctgataacgagtactcgtcacaggaagagagccaaagaaagccactccctacagccgcagcacaatgcagctttgaagatccagacagtgcagtggacgatagagattctgactataggagcgaaacctcaaactcatttccgcctccatatcacaccgccagtcagcccaatgcctctgtgcatcagtttccagtacccgtgagatccccacagcagcttcttctgcaggggagttcaagggattcttgtaatgattccatgcagagctacgatctggactatcccgagcgacgagctatcagtccaacatcttctagtcgttatggctcttcatgtaatgtgagccagggctctagccagctcagtgaactggaccagtatcacgagcaggatgacgaccacagagagaccgatagcatacactcttgccatagcagccattcattgagtcgcgatgggcaggccggttttggcgaacaggagaagcccctcgaagtgaccggccaggctgagaaagaggctgcatgcgaacccaaggagatgaaagaggacgccaccacccacccccctccagatcttgtgttgcagaaagaccactttcttggcccacaggaaagcttcccagaggagaatgcgtcctcacccttcacccaagcccgagcacactggattcgggctgtgacaaaagtgcgcctgcagttgcaggaaattcccgatgacggagacccctctctgcctcagtggctacctgaaggccctgctggaggactgtatggcatcgacagtatgccggacctaagacggaagaagcctcttccgttagtatccgacttgagtctagtgcagtctagaaaagccggaataacctctgcaatggccactcgcaccagcctcaaagatgaggaactgaaatcccatgtgtataagaagactctgcaggccctcatctatcccatctcttgtaccacacctcacaatttcgaagtgtggaccgcgactactcctacatactgctatgagtgtgagggcctgctttggggcattgcacgccaaggtatgagatgttcagagtgtggcgtcaaatgccatgaaaagtgccaagatcttctgaatgcagactgtctgcagagggcggctgaaaaaagctgcaaacatggagctgaagacagaacacagaatattattatggctatgaaagataggatgaagattagggaacgcaataaacctgaaatatttgaagtgatcagggacgttttcacggtcaacaaggccgctcatgtgcagcagatgaaaaccgtcaaacaaagcgtgctggacggcacatcaaagtggtccgccaagattaccattacagtggtgtgcgcccaggggctgcaagccaaggataaaacaggatcctccgacccttacgtcactgtccaggtaagtaagaccaagaaaaggaccaaaaccatcttcgggaaccttaatcccgtgtgggaagaaaagttccacttcgagtgtcacaatagcagcgaccgaatcaaggtgagagtgtgggacgaggatgacgatatcaagagccgggtcaaacagcgcctgaagagggagtctgatgattttctgggccagaccatcatcgaagttaggactctaagcggggaaatggatgtctggtacaatctggaaaaacgaaccgataaaagcgctgtgtcaggcgctatacgtctgcagataagtgttgagataaaaggtgaggagaaggtagccccttatcatgttcagtacacctgtttgcatgagaatctcttccactatctgaccgacatacagggcagcgggggtgtacgaatcccagaagccaggggcgatgatgcatggaaagtgtactttgatgaaactgcacaagaaatcgtggacgaatttgccatgcgctacggcatagagagtatttaccaggcaatgacacacttcgcctgcctgtcttccaagtacatgtgcccaggggtacccgcagtgatgagcaccctcctagccaacataaacgcctattacgcgcataccacagcgagtaccaatgtctctgcttctgacagatttgccgctagcaatttcggcaaagagcggttcgtcaagttgcttgaccagctacacaactctctccgcatcgacctgtcgacctacaggaataatttccccgcaggctcacccgagcggctgcaggacttgaagtctacagtagatttgctgacaagtataaccttttttcgcatgaaggtgcaggaactgcagtcacctcccagggctagtcaggtggtgaaagattgcgtgaaagcctgcctgaactcaacttatgagtatatttttaacaattgccacgatttgtacagtaggcagtatcagctgaaacaggagctgccccctgaagagcaggggccttctattcgcaacttggacttctggccaaagctgataacactgattgtgtcaattattgaggaggataaaaacagctacaccccagtgctcaaccaattccctcaggagttaaatgtcggcaaagtgtccgctgaggttatgtggcatctgtttgcgcaagacatgaagtatgctcttgaagagcatgaaaaggatcacctttgtaaatcagcggactacatgaatctgcacttcaaggttaaatggctgcataatgagtacgttagagacttgcccgtgctccagggacaggtgcctgaataccccgcatggtttgagcagtttgtgctccagtggctggacgaaaacgaggatgtgagcttggagttcctgagaggagccctggaacgcgacaaaaaagacgggtttcagcaaacgtctgagcatgctctgtttagctgttctgtagtggacgtgttcacacagctaaatcagagcttcgagatcatacgaaaattagagtgtccagatccctccatcttggctcattacatgaggaggtttgcaaaaacaatcggcaaagtcctgatgcagtatgccgacatcctctctaaagattttccagcgtactgcacgaaagagaagttaccttgtattctgatgaataatgtacaacagctgcgcgtccagttggaaaagatgtttgaagcaatgggcggaaaggaactggatctggaggcggctgacagcctaaaagaactgcaagtcaagttgaacacagtgttggacgaactttccatggtttttgggaactctttccaggtgaggattgatgaatgtgtgcgacagatggccgacatcctagggcaggtcagaggtaccggtaacgcgtccccggatgctagagcctcagccgcacaggacgctgactcagttcttcggcctttaatggatttcctcgatggcaacttgaccctgtttgccactgtgtgcgaaaaaacagtgctgaaacgagtgctaaaagagttgtggcgtgtggttatgaacactatggagcgtatgatcgtcctacccccattgacagaccaaaccggaacccagctgatctttaccgccgcaaaagaactgagtcatctctcaaagcttaaagatcacatggtgcgagaagagactaggaatctcacacctaagcaatgcgcggttctcgatctggccctggacactattaaacaatacttccacgcaggaggcaacggactgaagaagacgtttctcgagaaaagccccgacctgcaaagtcttagatacgctctttccctttacacccaaaccaccgatacactgataaaaacattcgtgagaagccaaacaacccaggggtctggtgtagacgaccctgtgggagaggtcagtatacaagtcgaccttttcacacacccgggaaccggtgagcataaggtaacagtgaaggtggtggcggcaaatgacctgaagtggcagacagccggaatgttcagaccctttgtggaggtcacaatggtcggtcctcaccaaagtgacaagaagaggaagttcacaacgaagagcaaaagcaacaattgggcccctaagtacaacgagacgttccactttctgctaggcaatgaggaagggccagagtcctatgaactgcagatctgcgttaaggactactgctttgctagggaggacagagtgctgggattggccgtgatgcccctgcgcgatgtcacagccaagggcagctgcgcctgctggtgtcccctcggaaggaaaatacatatggatgaaaccggcctaacgattctgagaatactgtctcagaggagcaacgacgaagtagccagagaattcgtgaaactgaaaagtgagtcgcgaagcacagaggaaggctcatag

SEQ ID NO: 55800 - DNA, 4833 bp, Artificial Sequence
  Description of Artificial Sequence: Synthetic coding sequence
atgagtctgctctgtgtgcgggtgaagagggccaagtttcagggctcccccgacaaattcaacacctacgtcacattaaaggtgcagaacgtgaagtcaaccacagtcgccgttcgcggtgatcagccgtcctgggagcaggacttcatgtttgaaatttccagactagacctcggattgtccgtggaagtttggaacaaaggcttaatttgggacactatggtggggactgtctggattgcactgaaaacaataaggcagagcgacgaagagggaccgggtgagtggtctacactggaggcggaaacactgatgaaagatgacgaaatatgcggcactaggaatcctacaccacataagatcctgttagataccaggttcgagctgccattcgatattcctgaggaggaggcaaggtattggacatataagtgggagcagattaacgccctgggcgctgacaatgagtactcatctcaagaggaatcccagaggaagcccctgccaaccgccgcagcacagtgttctttcgaagatcctgatagtgccgtagacgaccgggattccgattatcggtctgaaaccagcaatagttttccgccaccctaccataccgcgagccaaccgaatgccagtgtgcaccagttcccagttcctgtgcgcagtccacaacagcttctcctgcaaggtagttctagagattcttgcaacgattccatgcaaagctatgatctagactaccccgagaggagggccattagccccacctctagctctcgctatggttcgagctgcaatgtcagccagggctcttcacagctgagcgagctggaccagtaccacgaacaggacgacgatcacagggagaccgacagtatccattcttgccacagttcccactcactgtccagggacgggcaagcaggttttggtgaacaggaaaagccactcgaggttaccgggcaagctgaaaaggaggcagcttgcgagcctaaggaaatgaaagaggatgcaaccacccaccctccgcctgacctggtgttgcaaaaggatcactttctgggacctcaggagtctttcccagaagagaatgcatcctctccatttactcaggccagagctcactggattcgagctgtcacaaaggtacggctccagctccaagaaattccagacgatggtgacccttccttacctcagtggttgccggagggaccagctggcggactgtatggaatcgattcaatgccagatctgcggcgaaaaaaaccgctgcctcttgtgtcggacctgagtctggtgcagagccggaaggcaggtattactagcgcgatggctactaggactagtttgaaggatgaagagttgaaaagccacgtgtacaaaaagaccctgcaagccctgatttaccctatcagttgtacgaccccacacaattttgaagtgtggactgccactacaccgacctactgttacgaatgtgagggattactgtgggggattgctcggcagggaatgcggtgctccgaatgcggtgtcaaatgtcacgagaagtgtcaggatcttttaaatgctgactgtttgcagcgcgctgccgaaaagtcttgcaagcatggagccgaggatcggactcagaacatcataatggcaatgaaggataggatgaagatcagagagcggaataagcccgaaatattcgaagtgatacgcgatgtcttcacggtgaataaagccgctcacgtgcagcaaatgaagaccgtgaaacagagcgtgctggacggtacatctaagtggagtgccaagatcactattactgtcgtgtgcgcccaggggctgcaggccaaggacaaaactggtagttcggatccatatgtcaccgttcaggtgtcaaagactaagaagagaaccaagactattttcgggaacttgaatcctgtgtgggaagaaaaattccacttcgagtgtcacaatagctcggatagaatcaaagtacgagtgtgggacgaagatgatgatatcaagtccagggtgaaacagcgcttgaaacgagaatcagatgatttcctgggccaaacgatcatagaagttaggaccctttctggcgagatggacgtatggtacaacttggagaaacgcaccgacaaatccgctgtcagcggcgctatccgactgcaaatctcagttgagatcaaaggcgaagagaaagtagcaccttaccacgtacagtacacttgccttcacgagaacctttttcactatctgacagatatccagggaagtgggggtgtacgtattccagaagctcggggagacgacgcttggaaagtttacttcgacgagaccgctcaggagatcgtcgatgagttcgccatgcggtacggaatagagtctatctatcaagctatgacgcatttcgcatgtctgtctagcaaatatatgtgccctggagtacctgccgtgatgagcacacttctcgctaatataaacgcctactacgctcacacaaccgcatccaccaatgtgagcgctagcgaccgctttgctgctagtaattttggaaaggagaggttcgttaagctgctcgaccaattacacaacagcttacgcatcgacctcagcacttacagaaacaacttccctgccggtagcccggagcggcttcaagatctcaagtccaccgtggaccttctgacgtcaatcaccttttttcgcatgaaagtgcaggagctgcaaagcccaccacgggctagccaggtagtgaaggactgtgtgaaggcatgtctgaatagtacttacgagtacatattcaacaactgccacgatttatacagccggcagtaccaactcaaacaggaactgccccctgaggagcagggaccctcaattcgcaatctggatttctggcccaagttgattacacttattgtgtccattatcgaggaggataagaactcatacactccagtactcaatcagttcccgcaggaactcaacgtgggcaaagtctccgcagaagttatgtggcacctgttcgctcaggacatgaagtatgcacttgaagagcacgaaaaggatcacctgtgtaagtcagccgactacatgaatctacattttaaggtcaagtggttgcacaacgagtacgtccgagacctacccgtgttgcaggggcaagtgcctgaataccctgcctggttcgagcagtttgtgctgcaatggttggacgagaacgaggatgtgagtctggaatttctgcgtggcgcactggagagagacaagaaagacggatttcagcagaccagtgaacacgctctgttctcctgttctgtggtcgacgttttcacacagttgaaccagtcgttcgagatcattcggaagctcgaatgcccggatccgtccatccttgcacactatatgcgcaggtttgccaagactattggcaaagtgctgatgcagtatgctgatatcttgtcaaaagacttcccagcatattgcaccaaagaaaagttaccatgcattctgatgaataatgtacagcagcttcgggtccagctcgagaaaatgttcgaagcgatgggcggaaaagagctcgacctggaggcagccgattctcttaaggagcttcaggtaaaattgaacacagtactggacgaactgtctatggtttttgggaattctttccaggtgcgcatcgacgagtgtgtccgccaaatggctgatatactgggacaggtacgcggaaccggtaatgcttcacctgacgccagggcctctgccgctcaggacgccgattctgtgctcagacctctcatggattttctcgacggtaacctgactctgtttgcgacagtttgtgaaaagaccgtactgaagcgagtcctaaaggagctgtggcgggtcgttatgaatacaatggagcgcatgattgtgttaccccctcttaccgaccagactggcacccagcttatcttcacagcagcgaaggagctaagccatctcagcaaattgaaggaccacatggtaagagaagagacgcgcaatctgaccccaaagcaatgcgccgtcctcgacctggcccttgataccataaaacagtactttcatgctgggggtaacggcctcaagaagacattccttgaaaagagccccgatcttcagtccctcagatacgccctgagcctgtacacccagactaccgacaccctgataaagacattcgtaaggtcgcagacaacccaagtgcacgatggaaaaggcattcgcttcacagcgaatgaggacataaggcctgagaaaggctccggagttgacgaccctgtgggcgaagttagcatccaggtggatctctttacccaccctggcactggcgagcacaaagtgaccgtgaaagtggttgctgcaaatgatttgaagtggcagaccgccggtatgttccgcccatttgtagaggtgacaatggtggggcctcatcagtcagacaagaagaggaaatttacaaccaagagcaagagcaataattgggctcccaaatataatgaaacttttcatttcttactgggcaacgaggaggggcctgaaagctacgaactgcagatctgcgtgaaggactactgcttcgcaagagaggaccgggtattgggtttggccgtaatgccactccgtgacgtgacagctaaaggatcctgtgcatgctggtgcccactggggagaaagatccacatggacgagaccggcctgactattctcaggattcttagccagcgaagcaacgatgaagtcgctagggagtttgtgaagctgaaaagcgagtcccgctccacggaagaggggtcctag

SEQ ID NO: 55801 - DNA, 4869 bp, Artificial Sequence
  Description of Artificial Sequence: Synthetic coding sequence
atgtccctgctgtgcgtccgcgtgaagagagctaaatttcagggtagccccgataagtttaacacttatgtcaccttgaaagtgcagaacgtaaagagtactaccgtggcggtgcggggagatcagccaagctgggagcaagactttatgtttgagatctctcgcttagacttgggcctgtccgtggaagtgtggaacaaaggcctgatctgggacaccatggttggcactgtttggatcgctctgaagaccatccgtcaatctgatgaagaggggccaggggagtggagcaccctcgaggcggaaactctcatgaaagatgatgaaatctgtggcacaagaaatcctactccacataaaattcttctggataccagattcgaactccccttcgatatcccggaggaagaggccagatattggacatacaagtgggaacagattaacgctctaggcgctgacaatgaatactcctcccaagaggagagccagcgtaagccattaccaaccgctgcggctcaatgctgccactggacatatttaggatggggcgaacagcagacttttgaagacccagactcagcagtggatgatcgggatagcgactatcgcagcgagacctccaatagctttccacccccttatcacaccgcaagccagcctaacgccagcgtgcatcaattcccggttccagtaaggtctccccagcagcttttattacaaggctcatctcgggactcatgtaatgactcgatgcagagttacgacctggactatcccgagaggagagctatctcaccaacttcctcctctcgttatggctcgtcatgtaacgtttctcaaggctcctcccagttgtctgagctcgaccaataccacgaacaggacgacgaccatcgagagaccgacagcattcatagctgccactcctcccatagcttgtcccgggatggccaggcaggattcggcgaacaggaaaagcctcttgaggtgaccggccaggcggagaaagaggcagcctgtgaacctaaggaaatgaaggaggatgctacaacccatccacccccagacttagtgcttcaaaaagaccacttcctcggccctcaggaaagctttcctgaggaaaacgcttcatcccctttcactcaagcacgggctcattggattagagcagtaacaaaagtcagactccagttgcaggaaataccagacgacggggacccttctctaccacaatggcttcctgaagggcctgccggaggcctgtacggaatcgatagtatgcctgacctccgcaggaaaaaacccctgcctctggttagcgatttgagcttagtccagtcgagaaaggccggaattactagtgccatggccacccggacttccctcaaggacgaggagctgaaaagccacgtatataaaaagacattgcaggctttgatttaccctattagctgcactactcctcacaacttcgaggtatggacagctacgacccctacatattgctatgagtgtgaagggttgctctggggaatcgccagacaggggatgcgctgctcagagtgcggtgtaaagtgccacgagaagtgtcaggatttgcttaacgccgactgtctgcagagggccgcagaaaaaagctgcaagcacggcgctgaagaccgaacccagaacattatcatggcaatgaaagaccggatgaagattcgggagcgaaacaagccagaaatcttcgaggtgattcgcgacgtatttaccgtgaacaaggctgctcatgttcaacaaatgaaaaccgtgaaacagagcgtgttggatggcacctctaagtggagtgccaaaattaccattacagtggtctgcgctcagggactccaagctaaggataagaccgggtcatctgacccctacgtaacagtgcaggtcagcaaaaccaaaaaacgaacaaagactatttttgggaacttgaatcctgtgtgggaggaaaaattccactttgaatgtcataactccagcgatcgaattaaagtaagggtctgggacgaagacgatgacatcaaatcacgcgtcaagcagcggctgaaaagggaatccgacgacttcctcggccaaacaatcattgaggtgcgaacactgtctggtgaaatggacgtttggtacaatctggaaaagagaaccgataagagtgcagttagcggggcaatccgtctgcagatatcagtagaaataaaaggagaggagaaggtcgcaccttatcacgtccagtatacatgcctgcacgagaacctattccactatctgactgatatacagggatctggtggtgtgcgcattccagaggctagaggggacgatgcttggaaagtgtacttcgatgagaccgcccaagagatcgtggacgaattcgcgatgagatacggaattgagtctatctaccaagccatgacccattttgcatgcttgagttccaagtacatgtgccccggtgtccctgccgtcatgagtaccttgctggcaaacatcaacgcttattatgctcatactactgctagcacaaatgtcagtgcctccgatcgcttcgccgcatcaaattttggaaaagaacggtttgtgaaactactggatcagctgcataacagcctgcggattgacctctccacttacaggaataattttccagcaggctcccccgagaggcttcaggaccttaaatcaactgtggatctactgaccagtatcaccttcttccgaatgaaggttcaggaactccagtctccgcctcgggcttctcaggttgtaaaggactgtgtcaaggcgtgccttaatagcacctatgagtatatttttaacaattgccacgacttgtactctcgccagtatcagctcaagcaggagctgcctccggaagaacagggcccaagtatccgcaatctcgacttttggcccaagttgattaccctgatcgtgagcataatagaagaagataagaattcttacaccccggttcttaaccaatttcctcaggagctcaacgttggcaaggtatccgccgaggtcatgtggcatctatttgcacaggacatgaaatacgctctcgaggaacatgagaaagaccatctctgcaagagtgccgactacatgaacttgcattttaaagtgaaatggctccataatgaatacgtgcgcgatctgcccgtgcttcagggacaggtgccggagtacccagcctggttcgagcaattcgtgctacagtggcttgacgagaatgaggacgtaagtctggagttcttgaggggcgctttggaacgggataaaaaggacggctttcaacagacgtcggagcacgccttattcagctgctctgtcgttgatgtttttacccaacttaaccagtctttcgaaatcatacgcaaattggaatgccctgacccctccattcttgcacattatatgcgtagattcgctaaaactatcggaaaagtcctaatgcagtatgcagatattttatccaaggactttccagcctactgtaccaaggaaaaactcccttgcattttgatgaataatgttcagcagctgcgcgttcagcttgaaaagatgtttgaggctatgggcggtaaggaattggacttagaggccgcagattcattaaaagaactgcaggttaaactaaataccgtgttagatgagctctcaatggttttcggcaactcttttcaggtgcgaatcgatgaatgcgtgcgccagatggctgacattctcggccaggttcggggtactgggaacgcttcaccggatgctcgggctagcgctgcacaggacgctgactcggtgttacggcctctcatggactttctggacggcaaccttacactattcgcgactgtttgcgaaaagaccgtcttgaaaagggtattaaaggagctgtggagggtcgtcatgaacacaatggagagaatgattgtcctgccacccctcaccgatcagactggcacgcagctcatctttacagcagccaaggaactgagtcatctgtctaagttaaaggatcacatggtaagagaggagacccgtaacctcacccctaagcagtgtgcagtcctggacctggctctggataccatcaagcaatatttccatgccggagggaacgggctcaagaaaacctttttggagaagagcccagaccttcaaagcttgaggtatgccctctcactctatacccaaaccacagatacgctgatcaagacctttgtgagatctcagacgacacaggttcacgacggaaaaggcattcggttcacagctaacgaggatatcaggcccgagaaaggttctggcgtcgacgatcccgtgggcgaagtgtccattcaggtggacctgtttacccaccctgggacaggggaacacaaggtcaccgttaaggtggtggctgcaaacgacttgaaatggcaaaccgctggtatgttccggcctttcgtggaggtgacgatggtgggacctcaccagtccgacaagaagaggaagtttacaacaaaatctaagtccaacaattgggcgcctaagtacaacgaaactttccactttctcttaggaaatgaggaaggacctgagtcttatgaactgcaaatctgcgttaaggattactgtttcgctcgcgaggaccgagtgcttggtcttgcagtgatgccactgagggacgtgactgccaaaggctcctgcgcgtgttggtgtccattgggcaggaagattcacatggatgagacagggttgacaattcttaggatcctctctcagcgctccaacgatgaagttgccagggagttcgtcaagctaaaatcagagtccaggagtaccgaagagggatcttag

SEQ ID NO: 55802 - DNA, 3594 bp, Artificial Sequence
  Description of Artificial Sequence: Synthetic coding sequence
atgccggatctccggcgtaagaagcctctaccattggtctccgacctcgtcaaaagtctggtgcaaagccgcaaggccggaataacttctgctatggccacccgaacatccctcaaggacgaagaactgaaatctcacgtctacaagaaaacgttgcaggctttgatctacccaatatcctgcacgactccacataactttgaagtgtggaccgccaccactcccacgtactgctatgagtgcgaagggctgctgtgggggatcgcgagacagggcatgagatgtagcgagtgcggagttaagtgccatgaaaagtgccaggacctgctcaatgctgactgcctccagagggccgctgagaaatcgtgcaagcatggagcagaggataggacccagaatattatcatggcgatgaaggatcgaatgaagatcagagagcggaacaagccagaaattttcgaggtgatccgagatgttttcactgtgaacaaggcagcccatgttcagcagatgaagacagttaagcagtccgtgctggatgggacctcaaaatggtctgctaaaataaccatcacagtggtttgcgcccaaggtctgcaggccaaggacaagactgggagctcagacccctacgtgaccgtccaagtaagcaaaacgaagaagcggactaaaacaatctttggaaacctgaacccagtctgggaggagaagttccacttcgaatgccacaattcctccgataggataaaggttcgcgtgtgggatgaagacgacgacataaagagcagggtcaagcagcggctgaaaagggagtctgatgacttcctgggccagactataatagaagttagaaccctctccggcgagatggacgtctggtataacctggaaaaaagaacagacaaatcagctgtaagtggtgcaatcagattgcagatctctgtggagatcaagggcgaggaaaaggttgcgccatatcacgtgcagtatacttgcctgcatgaaaatctgttccattacctgacagatatacaaggttcagggggtgtgaggatccccgaggccaggggggacgacgcctggaaggtgtactttgacgagacagcccaggaaatcgttgatgagtttgccatgaggtacggaattgaatccatctatcaggctatgacacactttgcatgcctgtcgtcaaaatacatgtgtcccggagtacccgctgtcatgagcacactgcttgcgaatattaatgcctattacgctcacaccaccgcctccactaatgtaagtgcctccgatcggttcgcagctagtaacttcggcaaggaaagatttgtcaagcttctggatcagctgcacaactcactccggattgacctcagcacttataggaacaattttccagcaggaagccccgaaagactgcaagacctcaagtctacagttgacctcttgaccagtatcacattttttcgcatgaaggtgcaagagctgcagtcacctcctcgcgcatcacaggtcgttaaggattgtgtgaaagcgtgtctgaacagtacttacgaatatatcttcaacaattgccacgatctctactcacggcagtatcagttgaaacaagagctccctcccgaggaacagggtccttctatccgaaatctcgacttctggcccaagctcattaccttgattgtgagcattatcgaagaagacaaaaacagctacacccctgtcctcaaccagtttccacaggaactcaacgtcgggaaggtgagcgccgaggtaatgtggcacctctttgctcaggatatgaaatacgcattggaggagcatgagaaggatcacttgtgtaagtccgctgactacatgaacctgcactttaaggtcaaatggcttcataatgagtacgtccgggaccttccagtactgcaaggacaggtgcctgaatacccagcctggtttgaacagttcgtgctacagtggctagacgaaaacgaggacgtgagcctggagttcctaagaggcgctctggagagggacaagaaggacggatttcaacaaacaagcgagcacgccctgttttcgtgcagcgttgttgacgtcttcacgcagttaaatcagtccttcgagattatcaggaagctggagtgccccgaccccagcatcctggcccattacatgaggcgcttcgctaaaacaattggcaaagtgctgatgcaatacgcagatattctgtccaaggatttccctgcatattgcactaaggaaaagctcccatgcattttgatgaataatgtccaacagttacgcgtgcagctggagaagatgtttgaggcgatgggtggaaaagaactcgatctcgaagccgcagactctcttaaagaactgcaggtgaagcttaataccgtgctggatgaactgagtatggtgttcggaaattcctttcaagttaggatcgacgagtgcgtaagacagatggcagatatcttaggccaggtacgcggaacagggaatgcatctcccgatgctagagcgagcgccgctcaagatgcagacagcgtgctgcgtcctctgatggacttcctcgatgggaatctgaccctttttgcgacagtctgcgagaagaccgtacttaagcgcgtgcttaaagagctgtggcgggtggtgatgaacaccatggagcgaatgatcgtccttcccccacttacggatcagaccgggacccagctaattttcacggccgctaaagaactgagccacttgtctaaattgaaagaccacatggtgagggaggaaaccaggaacctcactcccaagcaatgcgccgtcctagatttagctcttgacacaataaagcaatattttcatgcaggaggtaacgggctaaaaaagactttcctcgaaaagtccccagacctgcagtctctaaggtacgcgctgtctctgtacacgcaaaccactgacacgcttattaaaacattcgttcggtctcagactacgcaggtgcacgatggtaaagggattcggtttacggccaatgaagacattagacccgagaaggggtccggcgtcgatgaccccgtgggcgaagtgtccatccaagttgacctgtttacccatccaggaacaggtgaacacaaagtgactgttaaagtcgttgcagccaacgacctgaagtggcaaactgcgggaatgtttcgcccttttgtggaagtgacaatggttggccctcaccaaagcgacaaaaagcgtaaatttactaccaagtccaaatccaacaactgggctcccaagtataatgagaccttccacttcctgctcgggaatgaagagggtccagaatcttacgagctccaaatctgcgtgaaggattactgttttgcccgagaagacagggttctgggactcgccgtgatgcccctgcgagacgttactgctaaaggaagctgtgcatgttggtgtcccctgggacgcaaaattcatatggatgaaacaggacttacaatcctacgcatcctaagccaacgtagcaatgacgaagtcgccagagaattcgtgaagctgaaatctgagtcccgttccacggaggagggctcatag

SEQ ID NO: 55803 - DNA, 6644 bp, Artificial Sequence
  Description of Artificial Sequence: Synthetic coding sequence
atggtggccaacttctttaagtcactaattctgccttacatccacaagctgtgcaaaggcatgttcaccaagaagctcggaaacacgaataagaacaaggaatacaggcagcaaaaaaaagaccaagactttcccaccgctggccagactaaaagcccaaaattttcttatacctttaaatctacggtgaagaagattgctaaatgttcatcaactcacaacctgtctacagaggaagacgaggcgtcgaaggagttctcactctctcccacgttcagctatcgggtggctatagctaacggcctacagaaaaacgctaaggtcactaatagtgataacgaggacctgctacaggaattgagttctatcgagtctagctacagcgagagcttgaatgaactgcgcagctcgacagagaaccaggctcagagcacgcacacaatgccagtgaggcgtaataggaagtcctcttccagcctcgccccttccgaagggagttctgatggagagcgaacacttcatggactcaagttgggcgcactgcggaagttacggaagtggaaaaagagtcaagagtgtgtgtccagcgacagcgaattgtccaccatgaagaagagttggggtattcgatctaagtccctggataggacagtgcgaaatccaaaaacaaacgctctggagcctggtttttcctctagtggctgcatatctcagacacacgacgtcatggaaatgatctttaaggaattgcaggggatatcccaaatagagacagagttgtccgaattacggggacatgttaacgcactgaaacacagcatcgacgagatcagttccagcgtagaagtagttcagtctgagatcgagcagctgaggacgggctttgtccagtcgagaagggagacccgcgatattcatgactatatcaagcacctgggccacatgggctctaaagcatcccttagattcctgaacgtgacggaggagcggttcgagtacgtggaaagcgtggtgtaccagatcctaatcgataaaatgggattcagcgatgcccctaacgcaattaaaatcgagtttgcacaacggataggacatcagagagactgtcctaatgccaaaccacgcccaatacttgtgtacttcgaaactccccaacaaagagattctgtgctcaaaaaatcctacaagctcaaggggacaggcatcggcataagcacggacattctgactcacgacatccgggagcgaaaggagaagggtatcccttccagccagacttacgagtccatggctattaagctgagtactcccgaaccaaagattaagaagaacaactggcagagcccagatgattcagacgaggacctagagtctgaccttaatcgcaatagctacgcggttctgtcaaaatcagagcttctgactaaaggttctaccagcaagccttcatcaaaatcccatagcgccagaagcaaaaacaaaactgcaaactccagccggatttctaataagtcagattatgacaagattagttcccagctgcctgagtcggatattctggaaaagcaaaccacaacccattacgccgacgctactcctctgtggcattctcaatctgattttttcactgccaaattgtctagatctgagagtgatttcagcaagttatgtcagagctactcagaggattttagcgagaatcagttctttactcgaaccaacggatcttccttgcttagctcgtcggatcgcgagctttggcagagaaaacaggaaggcacagcaaccctttacgacagtcctaaagatcaacacctgaacgggggagtgcagggaatccagggacagacggagacagaaaacaccgagacagtggactccggtatgtccaacggcatggtttgcgcttccggtgataggtcccactatagcgacagccagctgagtctccacgaggacctctctccctggaaggaatggaaccagggagccgatctcggcctcgattcctcgacacaagaaggattcgactatgaaactaattcactgttcgaccagcagttagacgtctataacaaggatctggagtaccttggcaagtgccatagcgatctgcaggatgattccgaatcctatgacctcacacaggacgacaacagttctccatgccctggcctggacaacgagccccaggggcaatgggtgggccaatatgattcgtatcagggcgctaactcaaacgagctttaccaaaaccagaaccagttgtccatgatgtaccggtctcagtcggagttgcagtccgacgacagcgaagacgcaccaccgaaatcgtggcactcccgcctgagcattgacctctcagataagactttttcattcccgaagtttgggagcacgctgcagagggccaagtctgccctggaggtggtttggaacaaatctacccaaagcttatcaggctacgaagattcaggatcaagtttaatgggcagatttcgcactctgagtcagtccacagccaatgagagttccaccacactggatagtgacgtttatactgaaccctattactacaaggctgaagacgaggaagactacacggaacctgtggcagacaatgaaactgattatgtggaggtcatggagcaagttctcgccaagttggagaatcgcacttctattacagagacagacgagcagatgcaggcctacgatcacttaagttacgagacaccgtacgagactccacaggacgaggggtacgacgggcctgccgatgatatggtgagtgaggagggattggaaccattgaatgaaacttctgcagaaatggaaatcagggaggacgagaatcagaacattcctgagcaaccggtagagattacgaaaccgaagcgaattaggccttcatttaaggaggctgcgctgcgggcttataagaaacagatggctgagctggaggaaaaaatcctggccggtgactcatcctccgttgatgagaaggccaggatcgtatctgggaacgacttggatgccagtaagttttcagccctgcaggtctgcgggggagcaggcggtggcttgtacgggatagattctatgccagacctgcgtcgtaagaagaccctcccgatcgtccgggacgtggcgatgacactggcagcacgcaaaagtggcctctcactagccatggtgatcagaacctccctcaacaacgaggaactgaaaatgcatgtgtttaagaagaccttgcaggccctgatatacccaatgtcctcaaccatcccacacaatttcgaggtttggacggcgactacaccgacttactgctatgagtgcgaaggattactgtgggggatcgccaggcaggggatgaagtgcctcgagtgtggagtgaaatgccacgagaaatgtcaagatctgctcaacgccgattgcctgcagcgcgctgccgaaaagtcatctaagcatggagctgaggacaaaacacagaccataattacagcgatgaaggagagaatgaagattagagagaagaataggccggaggtgttcgaggtcatccaggagatgttccagatctcaaaagaagactttgtccagtttactaaagccgctaagcagagtgtgctcgatggaactagcaaatggtctgcaaagataaccatcaccgtggtgtctgcacagggcttgcaagctaaggacaaaactggctccagcgatccatacgtcactgtacaggtaggcaaaaataagcgaaggacaaagactatttttggcaatcttaacccggtctgggatgaaaaattttatttcgagtgccataactcaaccgatcgcatcaaagtgcgcgtgtgggacgaggacgatgatatcaaaagccgcgtgaagcagcatttcaaaaaggagtcggacgactttttgggccagaccatagtcgaagtccggaccctcagtggggaaatggacgtgtggtataatcttgagaaaagaactgataagtctgctgtttccggagcgatcagacttaagattaatgtggagatcaagggagaggagaaggttgccccataccacattcagtatacatgtctgcatgagaacctgtttcactatttgaccgaggtgaaatccaatgggggtgtgaagatacctgaggtgaaaggcgacgaggcctggaaggtgtttttcgatgatgcttcccaagagattgttgacgagtttgccatgcggtacggcatcgaatcgatctaccaggccatgactcatttctcatgtctatcctctaaatacatgtgtcccggtgtccctgccgtgatgtccacacttctggccaatattaatgccttctacgcccacacgacagtgagtaccaatattcaggtgagcgcctccgatcggttcgctgccaccaatttcggacgggagaagtttataaaattactggatcagctacacaacagcctgaggatcgacctctctaagtacagagaaaattttcccgcatctaacaccgaaaggctgcaagatctgaagtctactgtggatttactcacatccatcacatttttcaggatgaaagtgctggaactccagtcaccccctaaagctagtatggtagtcaaagactgcgtgcgggcttgtctggattcaacatataagtacatttttgataactgccacgagttgtatagccagttaaccgatccctccaagaagcaagatattcccagagaggaccagggccctaccacaaaaaacttggacttttggcctcagttaattacattgatggtgaccatcattgatgaggataagaccgcctacacaccagtcctgaatcagttccctcaggagttaaacatggggaagatctctgccgagattatgtggacactcttcgctctggacatgaaatatgccctggaggagcacgagaaccagcgcttatgcaagtcgacagactacatgaatctccattttaaggtgaagtggttttacaatgagtatgtgagagaactgcctgctttcaaagacgccgtgcccgagtactcactgtggttcgagcccttcgtcatgcagtggctggatgagaatgaggatgtctccatggaatttctgcatggcgcattgggaagggacaagaaggatggctttcaacagacctcagagcatgctctgttctcttgttccgtggtagacgtgtttgctcagctgaatcagtccttcgaaattattaagaagctggaatgtcccaatccggaggccctctcacacttgatgaggcggtttgctaaaaccatcaacaaggtactcctgcagtatgccgcaatcgtttcttctgacttcagcagccattgcgataaagagaacgtgccctgcatccttatgaacaacatccaacagctgcgcgtccaactggagaagatgttcgaatcaatggggggtaaagaactggatagcgaggcaagtacgatattaaaggagttgcaggtgaagctgtcaggggtacttgatgagttgagcgtcacttacggtgaaagttttcaggtcatcatcgaggagtgcatcaaacagatgtcgtttgaactgaaccagatgcgagcgaatgggaacaccacttctaataagaactccgcggctatggacgctgaaattgttttgcgatccctcatggactttcttgacaagaccctctccctctctgcaaaaatttgcgagaagacggtactgaaaagggttcttaaggaattgtggaagctcgtgctgaataagatagagaaacaaatcgtcttgccaccattgactgaccagaccggcccacagatgatcttcattgcagccaaggacctaggacagctttccaagctgaaggagcatatgatccgcgaggacgctcgagggctaactccgcgacaatgcgcaatcatggaggtggtcctggcgaccataaagcaatactttcacgctggaggcaatggcttgaagaagaatttcctcgagaagtctccagatttacagagtttgcggtatgcactgtctctctacacccagactacagacgctctgatcaagaagttcatagatacccagacttctcagtcgcggagcagcaaggacgctgtgggacaaatctcagtgcacgtagatatcactgccacccccggtaccggagaccataaagtgactgtgaaggttatagcgattaacgacctgaattggcagacaactgccatgttcagaccctttgtcgaagtctgcatactcggcccaaacctcggcgacaagaaaagaaagcaaggcaccaagacaaaaagcaacacttggagccccaaatataacgagacctttcagttcatattggggaaagaaaacaggcccggtgcctacgagttgcacttatcagtgaaggattattgcttcgcccgagaggaccggatcatcgggatgacagttatccagcttcagaacatagctgaaaagggtagttatggagcatggtaccccctccttaagaatatttcgatggatgagactgggctaactattttgaggatactcagtcagcgaactagtgacgatgttgccaaggaattcgtgaggctcaaaagcgaaactagatccacggaagaatctgcata

SEQ ID NO: 55804 - DNA, 6638 bp, Artificial Sequence
  Description of Artificial Sequence: Synthetic coding sequence
atggtggccaattttttcaagagcctgattctcccgtatatacacaagctatgcaagggcatgttcacaaaaaagctcggcaacactaataagaataaggagtataggcagcagaagaaggaccaagatttccccactgcgggtcaaaccaaatctcccaaattcagctacacgttcaagagcaccgtcaagaagatcgctaaatgctcctcaacccataatctgtcgacagaggaagacgaggcgagtaaggaattctctctgtctcccaccttcagctatcgggttgccatcgccaacggtcttcagaaaaacgccaaagttaccaactcagacaacgaggatttgctgcaggaactcagctctatagagtctagctattctgagagtctgaatgagctccgaagctcaacagagaatcaggcgcagtccactcataccatgccggtgcgcagaaataggaagtcctcatcatctttagctccttccgagggatcttctgatggagagcgcactctgcacggcctcaagcttggcgctcttcgaaaactccgcaaatggaaaaaaagccaggagtgcgtgagtagtgacagtgagctttcgactatgaaaaagtcctggggtatccgctccaaatccttggacaggacagttcggaaccctaagacaaacgcgttagagccgggattcagcagcagtggttgcatttcacaaacccatgatgtaatggagatgatttttaaagaactgcaaggaattagccagatcgagaccgagctcagtgaacttaggggccacgtaaacgccctgaagcacagcatcgacgagatctcatcctctgtggaggtcgtccaaagcgagatcgagcaattgcgaaccggtttcgtacagtctcgaagagaaacacgcgatattcacgactatattaaacacctgggccatatggggagcaaggcatctctgcgttttcttaatgtcactgaagagcgtttcgaatatgtggaatcagtagtctaccagattttaatcgacaagatgggctttagcgatgcacctaacgcaatcaagattgaattcgctcaacggataggacaccaacgggactgccctaacgccaaacctcggcctattctcgtctattttgagacaccccagcagcgggattccgttctgaagaaaagttacaaactaaaagggactggcatcggcattagtaccgatattctgacccacgacataagagagcggaaagaaaaaggcataccttcctcacagacttacgagagtatggccatcaagctgtctacacccgaaccaaaaatcaagaagaataactggcagagcccggatgattccgacgaagaccttgagtcagatctgaaccgtaactcttatgccgtgttgagtaagtctgagctgctgaccaaggggtcaacatcaaaaccatcttcaaagagccattccgccagaagtaagaacaaaactgcaaactcttctaggatctcaaataagtctgattacgacaagatcagcagccaactgcccgagtcagacatactcgagaagcagaccaccacacattacgccgatgctacccccctctggcactcacaaagcgatttttttacggccaagctatcaagatccgaatctgatttctcaaagctttgccaaagctacagtgaagatttttccgagaaccagtttttcacgcggaccaacggctccagcctgctgagcagcagcgatagagagttatggcagcgcaagcaggagggcacagcaactctgtatgatagcccaaaagaccaacatctaaatggaggcgtccaggggatccagggccagacagagacagagaacacagagaccgtcgactctgggatgagcaatggtatggtgtgcgccagcggcgatcgttctcactatagcgactcccaattgtctctccatgaagacctgtcgccgtggaaagagtggaaccagggtgctgaccttggactcgactcctccactcaggaaggatttgactatgaaacaaactcgctttttgatcagcaactggatgtgtataataaagacttggagtatctggggaagtgtcattctgaccttcaggatgactcagagtcctacgatctcacacaggatgataattcttcgccgtgtcctgggctggacaacgagccacagggacagtgggtgggacagtacgatagttaccaaggggcaaacagcaatgaattgtaccaaaaccagaaccaacttagcatgatgtatagatctcagtctgaactgcagtccgatgactccgaagatgcacctccgaagtcatggcatagtaggctgtccatagatctgtcagataaaactttctcttttcccaagttcggatccacacttcagcgagctaagtctgctctggaagttgtctggaacaaaagcacacaatcgctttctgggtacgaagatagcggatcatctcttatggggcgattccgcactttgtcccaaagtaccgcaaacgagtcctctactaccttggactctgacgtctacacggaaccgtactattacaaggctgaggatgaggaggactatactgagcctgtggcagataacgaaactgactacgtggaggtaatggaacaggtccttgcaaaattggaaaacagaacatccattactgagaccgacgaacagatgcaggcgtatgatcacttgagctatgaaaccccctacgagacacctcaggacgaaggatacgacggtccggctgacgatatggtgtcagaggagggtctggagccactgaacgagacttccgccgagatggaaatccgagaagacgaaaaccagaacatccctgagcagcccgttgaaatcactaagcccaaacgaattcggcctagctttaaggaagctgcactgcgcgcttacaagaaacagatggccgaactggaggagaaaattctcgcgggtgattcttctagcgtggatgagaaggctcgaatcgtgtccggtaatgatctggatgcctccaagttttcagccctgcaggtatgcggtggcgctggcggtggtctgtacgggatcgattcaatgcccgatcttcggagaaaaaaaacccttcccattgtgcgggacgtgacattagccgctcgtaagtccggactgagtctagccatggtcattcgcacgtccctgaacaatgaggaactcaaaatgcacgtgttcaagaagactctgcaggcgttaatttatcccatgagctcgacgattcctcacaattttgaagtgtggaccgcgactacaccgacgtattgttacgagtgcgaaggccttctgtggggcatcgctaggcagggcatgaagtgccttgagtgtggggttaaatgtcatgagaagtgtcaggacttacttaatgccgattgtcttcagagggctgcagaaaagtcctctaagcacggcgcagaggacaagactcagacaatcattaccgctatgaaagaacggatgaagatccgggaaaagaatagacccgaagtatttgaggtgatacaggagatgttccagatatccaaggaggactttgttcagtttacaaaagccgcaaagcagtcagttctcgacggaactagtaagtggagcgccaaaattactattacagtggtcagcgctcaaggacttcaggccaaggacaaaacagggtcaagcgacccttacgttactgtgcaagtagggaagaacaaaaggcgaaccaaaactatttttggcaacctcaaccccgtctgggacgaaaagttctatttcgagtgccacaacagtacggatcgcattaaggtgcgggtctgggacgaagatgacgacataaagtccagggtcaagcagcatttcaagaaagagtcagacgatttcttgggccagacaatagttgaggtccgtactctaagtggcgagatggacgtttggtacaatctggaaaagaggactgacaagtctgccgtgtccggcgcaatccgactcaagatcaatgtggagattaagggcgaggaaaaagtcgccccatatcatatccagtatacatgtctccacgagaatctgttccattacctcacagaggtcaaaagtaacggtggcgtcaagataccagaagttaagggcgatgaggcttggaaggttttcttcgatgacgcaagccaggaaatcgtagatgaattcgcgatgcggtacgggatcgagtccatttatcaggcaatgactcatttttcttgtctgtcatccaaatacatgtgtccaggcgtcccggcagttatgtctacccttctggcaaacattaacgccttctacgcacacacaactgtctctaccaatatacaggtttctgctagcgacagattcgcagccacgaacttcgggagagagaagttcataaaactactggatcaactgcataattctctgcggatcgatctgagcaagtatagagaaaatttccctgcaagtaacacggaaaggctccaggatcttaaaagtactgtggacctactaaccagcattaccttttttcggatgaaggtgctcgaactgcagagcccacctaaagcctccatggttgtgaaggactgtgtgcgcgcatgtctcgacagtacttataaatatatttttgacaactgtcatgagttgtactcccagctcactgatccatccaaaaagcaggatatccctagggaggatcagggacctacgactaaaaatctggacttttggccacagctgattactctgatggttacgatcattgatgaagataagacagcatacactccagtgttaaatcagttcccccaggagctgaacatgggcaagatcagtgcagagattatgtggacgctatttgctctggacatgaaatatgctctagaggaacatgagaaccaaaggttatgcaaaagtaccgactatatgaatctgcacttcaaggttaaatggttttacaacgagtatgtccgcgaattgccagcctttaaggatgctgtgcccgaatatagtctgtggttcgagccttttgtgatgcagtggctcgatgaaaatgaggatgttagcatggagttcttacacggcgctctgggtagggataagaaggacgggttccaacagacttcagagcatgccctgttttcctgctccgtagtcgacgtgttcgcccagctgaaccagtcgtttgagatcattaagaagcttgagtgccccaacccggaagccctgtcacacctgatgagacggtttgcaaagaccattaacaaagtgttgctccaatacgcagcaatcgtgagcagtgatttctcttcccattgtgataaggagaacgtcccatgtatactgatgaataacatccagcaattgagggtccagctggagaaaatgtttgagtctatgggcggtaaggagcttgattccgaggctagtacaatcctcaaagaactccaagtgaagctgagtggagtgctggacgaactctcagtgacttacggagagtctttccaggtaatcatcgaggaatgcattaaacagatgtcctttgaactgaaccagatgcgcgctaacggaaacacaacatcaaataaaaatagtgcggctatggacgccgaaatcgtcctgcgctcgttgatggattttctcgataaaaccctctccttgtctgccaaaatatgtgaaaagaccgtgctcaagagggtcctgaaggaactgtggaaactggtcctcaacaaaatagagaaacagatagtccttccccctctcacagatcaaacaggcccacaaatgatctttattgccgcaaaagacctgggacagctgagtaagctaaaggagcacatgattcgggaggatgccagaggccttacccccaggcagtgcgcaattatggaagtggtcctggcaactattaagcagtatttccacgcaggaggcaacgggttaaaaaaaaactttctcgagaagtcgcctgatctccagagtcttaggtacgctctgtccctgtacacacagactacagatgccctgattaaaaaattcattgatacacagactagccagagcaggtccagcaaagacgcggttggacaaatctctgtgcatgtggatattaccgccacgccaggaactggagaccataaagtcactgtcaaagtgatcgctattaacgatctgaattggcagactaccgcaatgtttagaccattcgttgaggtctgcatcctcggtcccaacctcggcgataagaagcgcaaacaggggaccaagaccaagtccaacacttggtcacctaagtataatgagacgttccagttcatcctgggaaaggaaaatcggcctggagcatacgaattgcatcttagcgtgaaggattactgcttcgccagggaggatcgcatcattggaatgactgtgatccagctccagaatatcgcagaaaagggatcatacggtgcatggtacccactgttgaagaatatcagcatggatgagacaggtttgactatcctgcggatcctgtcccagcgcaccagcgatgacgtggctaaggagttcgtcagattaaagtctgagacaagatccaccgaggaatctgcgta

SEQ ID NO: 55805 - DNA, 6644 bp, Artificial Sequence
  Description of Artificial Sequence: Synthetic coding sequence
atggtggccaactttttcaaatcattgattctgccatacatccataagctgtgtaagggcatgttcacgaagaagctgggtaacactaataaaaacaaggagtaccgacagcagaaaaaggaccaagattttcccacagctggacaaaccaagtcaccaaaattcagttatacttttaagagcaccgtcaaaaagatcgccaagtgttcaagcacacacaatctgtctaccgaggaggatgaagccagcaaggagttcagcctctctccaactttcagctaccgggtcgcaatcgccaatgggctgcagaaaaacgcgaaggtgacaaactcggacaacgaagatctcctccaagaactttcatcgatcgaatcgagttactcagagtctctgaatgagctgcgcagctctacagagaaccaagcacagtcaacacacaccatgcctgtgcgcaggaaccgcaagtcctcgagctctttggctccatcagaaggctcttccgatggggagagaacactccatgggctgaagctaggggctctgaggaagctcagaaagtggaaaaaatctcaggagtgtgtgagttccgactccgagctcagtacaatgaagaaaagctggggaattagaagtaagtccctggaccggactgtcaggaaccctaagaccaacgccctggagcccggtttctcgtcctctggctgcatatcccagacacatgatgtcatggagatgatcttcaaggaacttcaaggaatcagtcagatcgaaaccgagctgagcgaactgcggggacacgtgaatgccttgaagcatagcatcgatgaaatctcttctagcgtggaagtcgtgcagagcgaaatcgagcagttgaggaccggcttcgttcagtcccggagggagacaagggacatacacgattacatcaaacatcttgggcatatgggcagcaaggctagcctgcgcttcctcaatgtcaccgaggaacggtttgagtacgtcgaatcagtggtataccaaatccttatcgataagatggggttcagtgacgctccaaacgccattaagattgaatttgcacagcggatcggacaccaacgcgactgccctaacgccaagcccagaccaattttagtttattttgagactcctcagcagcgcgactctgtattaaagaaatcgtacaaactgaaaggaacagggatcggtataagtaccgatatactcacgcacgacatccgagagagaaaggagaagggcatccctagtagccagacatacgagagcatggccataaaacttagcaccccagaacccaaaataaaaaaaaacaactggcagagccccgacgattctgacgaggacctggagtcagatctgaacaggaatagctacgcggtcctgagcaaatctgagcttctgactaaggggtcaaccagcaaaccctcaagtaaatcccatagcgccagatccaagaataaaaccgctaattcctcccgaatatccaacaaatctgattacgacaaaattagttctcagctgccagaatcagatattctggagaagcagacaactacacactatgcggacgcaacaccactgtggcacagtcaatctgatttcttcaccgcaaagctttccaggtccgaatcagacttctccaagctgtgtcaaagttactctgaggactttagcgagaaccaattctttacacgaacaaacggcagctctctgttatcttcaagcgatcgcgaactgtggcaaagaaaacaggaagggaccgccactctgtacgacagcccaaaggatcagcaccttaatggcggagtgcagggtatccaggggcagacagagactgaaaatacagagacagtggatagcgggatgtcgaacggcatggtctgcgccagcggcgaccggagtcattatagcgattcccagctgtctctgcatgaggacctttccccctggaaagagtggaaccaaggggctgacctcgggctggattcctccacccaggaagggttcgactacgagaccaactccctattcgaccaacagctggacgtgtacaataaggaccttgagtatctggggaaatgtcacagtgacctgcaggatgattcggagtcctacgacttgacacaagatgacaacagctcaccatgccccggtcttgataacgaaccgcaggggcaatgggtgggacagtacgattcttaccagggcgctaatagcaatgaactgtatcaaaatcagaaccagctgagtatgatgtatcggtcgcagtccgaacttcagagcgacgactctgaagatgctccccctaagagctggcatagtcgactctccatcgacttgagcgacaaaacctttagttttcctaagtttggatcaacccttcagcgggctaagtcagcactggaggtcgtgtggaataagtccacacaatcactctcggggtatgaagattccggatctagcttaatgggaaggttccggacattgtcgcagagtacagctaatgagtcttccacaactttagactccgatgtttacactgaaccgtactactataaggcggaagacgaggaggattacaccgagccagttgctgataatgagaccgactacgtggaggtcatggagcaggtcctagccaaactggagaatcgaacaagcatcactgagaccgacgaacagatgcaagcctatgaccacctctcttacgagaccccgtatgagacaccacaggacgagggctacgatggacctgccgatgatatggtgtctgaggaaggacttgagccacttaacgaaacttcagctgagatggagataagagaggacgaaaatcagaacataccagaacaaccagtggagatcacaaaaccgaaacgcatcaggccctccttcaaagaggccgcactgcgggcttataaaaaacagatggcagagttggaggagaagattctggccggagtgagcctggatgtggatctggaagcacggattgtttcagggaatgatctggatgcttccaagtttagtgccctgcaagtttgcggtggcgcagggggtggtctctatggaattgacagtatgcccgatttgaggcgtaaaaaaactctccctatcgtgagggacgtcctcctcactttggctgccaggaagtcaggcctgtccctggccatggtgattcgcactagcctcaataatgaggagctcaagatgcacgtctttaagaagaccttgcaggcccttatctatccgatgagttctactattcctcacaacttcgaagtttggacagctactacacccacgtactgttacgaatgtgagggcctactgtggggtatcgcacgacagggtatgaagtgcctcgagtgtggagttaagtgccacgaaaaatgccaggacctgctcaacgcagactgcctccagcgcgcagccgagaagtcttctaaacacggggctgaagacaagactcagaccatcataaccgctatgaaagagcggatgaaaattagagagaagaaccgccctgaagttttcgaggtaatccaggagatgtttcagattagtaaagaagattttgtacagtttaccaaagctgctaaacagtccgtccttgacggaaccagcaagtggagtgcgaaaattacaattaccgtagtgagcgctcaaggactccaggcgaaagacaaaacaggaagttctgacccttatgtgactgtgcaggtgggaaagaataagcggaggaccaagacaattttcggcaacctcaaccctgtgtgggacgaaaaattttactttgaatgtcacaattccactgacaggattaaggtcagagtatgggatgaggacgatgatataaagtctagagtgaagcagcatttcaagaaggagagcgacgatttcctgggacagactattgtcgaggtgcggacgttatcaggagaaatggatgtttggtacaaccttgagaagcgaaccgacaaaagcgccgtctctggagctattcgcctgaagatcaatgttgagattaaaggtgaagagaaggtcgccccataccacatccagtacacttgcttgcacgaaaacctctttcattatctcacagaagtgaagagcaacggaggagtgaaaatccccgaggtgaagggcgacgaagcgtggaaggttttctttgacgatgcctcccaggaaattgtggatgaatttgccatgcgctacgggattgaatctatctaccaggccatgactcactttagctgtttatctagcaagtacatgtgtccgggagtgccggcagtcatgagcacacttctcgcaaacatcaacgcgttttacgcccatactaccgtgagcaccaatatccaggtcagtgcctctgaccggtttgctgccaccaacttcggacgggaaaagttcatcaaattgctagatcagctccacaatagcctgcgcatcgatctgtctaagtacagagagaattttcctgcctctaacacggaaaggctccaagacctcaagagcactgtggatctgctgacttccatcactttttttagaatgaaggtactggagctgcagtctccacctaaggcctccatggtagtaaaagattgtgtaagggcgtgtctggactctacttataagtacatcttcgacaactgtcatgaactctattcccaattgaccgaccccagcaagaaacaggatattccccgtgaggaccagggaccaaccaccaagaatctggatttctggccgcagctgatcacacttatggtcacaattatcgacgaggataagactgcctacaccccagtcctgaatcagtttccgcaggagctgaatatgggcaagatctcagctgagattatgtggaccctttttgccctagatatgaagtacgctctagaggagcacgaaaatcagaggctgtgtaagtcgacggattacatgaaccttcattttaaggtaaagtggttctataacgagtacgttagagagctgcccgctttcaaagatgccgtccctgaatatagcctgtggttcgagccattcgttatgcagtggctggacgaaaatgaagatgtgtctatggaattcttacatggggctctaggacgggacaaaaaggacggcttccaacagacgtcagaacatgccctctttagttgtagcgtggtagacgtcttcgcccaactgaatcagagtttcgagatcatcaagaaactggagtgccccaatcccgaagctctgagccacttgatgcgcaggtttgccaagactattaataaggtgctcttgcagtatgcggcaatcgtcagctccgactttagctcgcactgcgataaggaaaatgtgccctgcatccttatgaacaatattcaacagttacgcgtgcagctggagaagatgtttgaaagcatgggtggaaaggaactggattctgaggccagtactattttaaaagagttacaggtcaagctgtccggtgtgctggacgagctgtcagttacctacggcgaatcatttcaagttatcatcgaggagtgtatcaagcagatgagctttgagttaaatcaaatgcgtgccaatgggaatacgacaagcaataagaactccgccgctatggacgccgagatcgttttaagatccctcatggatttcctcgataaaacattgagcctgagcgctaagatctgtgaaaaaactgtgttaaagcgtgtgctcaaggaactgtggaaacttgtgttgaataaaatcgagaaacaaatcgtattgcctccattgactgaccagacagggccacagatgatatttatcgcggctaaagatttgggccaactctctaaactgaaagagcatatgatccgcgaagacgctcgcggtctgacacctcgccaatgtgctatcatggaggtggtgctcgctacaattaagcagtatttccatgccggagggaacggattaaagaaaaatttcctcgagaaatcgcctgacttgcagtccctacggtacgccctcagtttgtacactcagactacagatgcgctcattaagaagttcatagatacacagacctcacaaagtcggtcaagcaaggacgccgtgggccagattagtgtgcatgtcgacattactgctactccaggaactggagatcacaaggtgacagtgaaagtgatagctattaacgatctcaattggcagactaccgccatgtttagaccgtttgtggaggtatgcatcctgggccctaatctgggcgacaaaaaacgaaaacaggggacaaagactaagagcaatacatggtcccccaagtataacgaaacattccaatttattctgggaaaggagaataggcccggagcctatgaactgcacttgagcgtaaaggattactgcttcgccagggaagataggatcatagggatgacggtgatccagttgcaaaacattgccgaaaagggtagctacggcgcatggtaccctttgctcaaaaacatttccatggatgagaccggcctgaccattctgaggatcctctcgcagagaacatccgacgacgtcgccaaggagtttgttcgtcttaagagcgagaccagaagcacggaagagtctgccta

SEQ ID NO: 55806 - DNA, 1557 bp, Artificial Sequence
  Description of Artificial Sequence: Synthetic coding sequence
atgtgcccacaggaaagcagttttcaaccctcccaattcctgttattggtcggcgtgccagttgccagtgtcctgctcctggcacagtgtctacgatggcactgtcctagacggttattgggggcttgctggacactgaatggacaggaggaacctgtttctcaacccacaccgcagctggagaacgaggtgtctcggcagcatcttcctgcaaccctgccagagatggtggctttctatcaggaactgcatactccaacacaggggcaaacaatggtgaggcagctcatgcacaagttgctcgtcttctcggcacgtgaagtggaccaccgtggtgggtgcctcatgctacaagatactgggatcagtcttcttatccccccaggagcagtggcggtcggacgtcaggagagagtaagcttaatccttgtgtgggatctgtccgacgctcctagcctgtcgcaggcacaaggcctggtgagtccagtagtggcttgcgggccacatggcgcatcctttctgaaaccttgcaccctgacattcaaacactgcgctgaacaaccttcgcacgctaggacatactcctcaaacactactttactcgacgccaaggtatggagacccctgggaagacccggagctcatgccagtcgagacgaatgccggatccatttaagccacttttcactctacacttgtgtgctagaagccccagtcggaagggaagctagaaagtggttgcagctggccgtattctgctctcccctggtacccggtcagagtcaccttcagcttcggatttatttcttaaataacaccccatgcgcactccagtgggccctgactaatgagcagccacatggcggtagattaaggggcccatgccagttgtttgacttcaatggagctcggggagaccagtgcctgaagctcacatatatctccgaaggctgggaaaacgttgacgatagcagttgccaactggttcctcatctgcacatatggcatggcaagtgccccttccggtccttttgttttaggcggaaggctgccgatgaaaacgaagattgctcagcccttactaacgagatcatagtcaccatgcataccttccaggatggactggaaacaaagtacatggagattctgcgtttccaggcctctgaggaggagagttgggccgcacccccacccgtatcccaaccacccccatgtaatagattgccaccagagctgttcgaacaactgcggatgcttctcgaaccaaactcaataactggtaacgattggaggcggttggcatctcatctcggcctgtgtggcatgaaaatcaggttcctgtcttgccaaagatccccagcagccgctatcttggaactctttgaggagcaaaacggaagcctgcaggaactgcactacctgatgacggttatggaacgactagactgcgcttctgcaatccagaattacttaagtggcacacatggcggatctccagggccagaaaggggaggcgctagagacaaccagggcctggagctggacgagaagctctag

SEQ ID NO: 55807 - DNA, 1557 bp, Artificial Sequence
  Description of Artificial Sequence: Synthetic coding sequence
atgtgcccacaagagagctcattccagccaagccaatttctactgctagtgggagtacccgtcgcctccgtcctactgctggcccaatgtctgaggtggcattgcccaagacggcttctaggcgcatgttggacacttaacggacaggaagagccggtgtcgcagcccactcctcaacttgagaacgaagtgtccaggcagcatttgcccgctactctccccgagatggtcgccttttaccaggagctgcacaccccaacccagggccagactatggtcaggcagctcatgcacaaactgttggtgttcagtgccagagaggtggatcacagaggcggttgtcttatgttgcaggacacggggatcagcttgctgattccaccgggagccgtagctgtgggacggcaggagagggtttccctcatcctcgtgtgggatctctcggacgccccatccctgtctcaggcacagggcttggtctcccctgtggtggcctgcggccctcacggggctagcttcttaaaaccttgcaccttaacctttaagcattgtgcagaacaaccctcacacgctaggacatactcttctaacaccaccctactggatgcaaaggtctggagacccctgggaaggcccggtgcacatgctagcagagatgaatgccgaatccatctgtctcacttttccctttatacgtgcgtgctcgaagctcctgtggggagagaggcccgtaaatggctgcagcttgctgtgttctgttcccctttggtgccgggacagtcccacctccagttgcgaatctattttcttaataacacgccatgtgccctgcaatgggctttgacaaacgagcagcctcacggtggcagacttcgaggcccttgtcaacttttcgacttcaacggtgcacgaggagatcagtgtctgaaactgacttacatatcagaaggctgggagaatgtcgatgacagcagttgccagctcgtgcctcatttacacatatggcacggaaaatgcccatttcggtccttctgctttcgacggaaggctgctgacgagaatgaagattgctcagcattaaccaacgagatcatcgtaactatgcacacatttcaggatggtctggagacaaagtatatggagatcctccggttccaggcctctgaagaggaatcatgggcggcaccacctccagtctctcaaccgcctccatgcaacagactgcccccagagctcttcgagcagttgaggatgctcctcgagccaaactctataaccgggaacgattggcgtaggttagctagtcacctggggctctgcgggatgaaaattagattcctgtcctgtcaacgctctcctgcagccgcaattcttgagctgtttgaggaacagaatggatctcttcaagaactgcactacttgatgacagtaatggagcgattagattgcgccagtgctatccagaactacctgagcggtactcacgggggtagcccgggaccagagagaggcggtgcgagagacaatcaagggctagagttagatgagaaactatag

SEQ ID NO: 55808 - DNA, 2862 bp, Artificial Sequence
  Description of Artificial Sequence: Synthetic coding sequence
atgggcagagctgccgcaaccgcagggggaggaggtggtgctcggaggtggcttccatggctaggactgtgtttctgggccgctggtactgcagccgctcgcggaaccgacaacggggaagccctgcccgaaagcatcccgagcgcaccagggacacttcctcacttcattgaagagcctgatgatgcctatataattaaatccaacccaatagccctgcgctgcaaggccaggcccgcaatgcagatattctttaagtgcaatggggagtgggtccaccagaatgaacacgtttccgaagagacattggacgaatcatctggccttaaagttcgggaagtcttcattaatgtgacccgtcagcaggtggaggattttcacggccctgaggattattggtgccaatgcgtggcttggtcccacctggggactagcaaatcgcgtaaggctagcgttaggatcgcctacttaaggaagaacttcgaacaggatccacagggacgagaggtgcccatagaaggcatgattgtactgcattgccgccctcccgaaggggtcccagccgcagaagtcgagtggctgaagaacgaggaaccaatcgacagcgaacaggacgagaacattgatactagggccgaccacaatcttattatcagacaggccaggctgtctgactcaggcaactacacttgcatggctgccaatatcgtcgccaaaagaaggtctttaagcgctacggttgtggtctatgtgaacggaggctggtcatcctggaccgagtggtcagcctgtaatgtgcggtgtggacgaggctggcagaaacggagccgcacttgcaccaaccccgcacccctgaatgggggtgctttctgcgaagggatgtcagtgcagaaaattacttgtacatctctttgtccagtggacggcagctgggaagtatggtccgaatggtcagtatgcagccctgaatgtgaacaccttcgcattagagagtgcacggcccctccccctaggaatgggggaaaattctgcgaaggcctgtcccaggagagtgagaattgtacggatgggctctgcattctagacaagaagccgctccacgaaataaagccccaatccatagagaatgcttccgacatcgccctgtactctggtctgggtgcagccgttgtggcagtcgccgtcctggtgatcggcgtgactctttacagaaggagtcagagcgactacggagtggacgtcatagattcatccgctttgactggaggctttcagactttcaactttaagaccgttagacagggcaactcactccttctgaatagcgccatgcaacccgacttgacagtcagccggacctatagcgggccaatctgtctacaggaccccttggacaaggagctcatgaccgagtccagtctgtttaatcctctgtccgatatcaaggtgaaagttcagtcttcattcatggtctctctcggggtgtcggaacgtgcagagtatcatgggaaaaatcatagccgcacatttcctcatggcaacaatcactccttttcgaccatgcatccacgtaataagatgccatatatccagaacttatctagccttccgacacggaccgagctcaggaccacaggcgtctttggacacttagggggacggctggtgatgcccaacactggggtgtccttactaatcccccatggcgctatcccagaggaaaacagctgggaaatttacatgtccattaaccagggggagccgtcactgcagtcagatggatctgaggtcctcttgtcccccgaggtgacctgcggacccccagacatgatagtcacgacacctttcgccttgaccatcccacattgcgctgacgtgtcgtcagagcattggaatatacatctcaagaaaaggacccagcagggcaagtgggaagaggtgatgtctgtcgaggatgagtctacctcctgttactgcctactcgacccttttgcttgtcacgtgctgttggattctttcgggacttatgccctaacgggagaacccattaccgactgcgccgtgaaacagcttaaggtggccgttttcgggtgtatgtcatgcaattcactggactacaatctgagagtttattgtgtcgacaatactccctgcgccttccaagaggtagtctccgacgagagacaccaggggggacagttactggaggagcccaaattactccacttcaaagggaacactttctcgctacagataagcgtgttggatattccgccattcctctggcgcatcaaaccatttaccgcgtgccaggaggtgcccttctccagggtgtggtgcagtaataggcagcccctgcattgtgctttctctttggaacggtacactccaaccaccacccagctctcatgtaagatatgcattcgacagcttaagggccacgagcagatactgcaggttcaaaccagtatccttgagagtgagcgtgagaccataacatttttcgctcaagaggactccactttccctgctcaaaccgggccaaaagccttcaaaattccctattcaatccgacagagaatctgcgccacttttgatactccaaacgccaaaggaaaagattggcagatgctggcacagaagaattctataaatcgaaacctatcctacttcgccactcagtcatccccctctgccgtgattctcaacttgtgggaggcaaggcatcaacatgacggcgatctggactccctggcatgcgcactggaagaaatcggcagaacccacacaaagctgtccaacatcagcgagtcgcagctcgacgaagctgattttaattattcaagacaaaacggactttag

SEQ ID NO: 55809 - DNA, 2847 bp, Artificial Sequence
  Description of Artificial Sequence: Synthetic coding sequence
atgatcctagtcctggttaaagccctcagtgacgtgtgtgctggaacttccggatttctgctcgatttctctagccagacctccccaggaacagacaatggggaggctttgccagagtccattccctccgccccaggcactctgccccattttatagaagagccagatgatgcctatatcattaaaagcaatcctatcgctctgaggtgtaaagctaggccagcgatgcaaatattctttaaatgtaacggtgagtgggtgcaccaaaatgaacacgtaagtgaggaaactctggatgagagctccggtctgaaagtgcgtgaggtgtttattaacgtgacacgccagcaggtggaggattttcacggacccgaggactactggtgtcagtgtgttgcatggtcacatctgggcacctccaagtcccggaaggcctctgtaaggatcgcttacctcagaaagaactttgagcaagatccacaggggagggaggtccctatcgaggggatgatcgtgctgcattgcaggccccctgaaggcgttccagcggctgaggtggagtggctcaagaacgaagagccaattgactctgaacaggatgagaatatcgacacacgagctgaccacaaccttatcatccggcaggctcggctgagcgatagcggcaactacacctgtatggccgctaacatagtggcgaagcgacgcagcctgagcgctacagtcgtagtgtatgtgaacgggggatggtcttcttggacagagtggagtgcctgcaacgtgagatgcggcagaggatggcagaagcggagccgaacatgtaccaatcccgctcctctgaacgggggtgccttctgcgaaggtatgtcggtgcaaaagatcacttgcacgtccctgtgtccagtcgatggaagctgggaagtctggagcgaatggtccgtgtgtagccccgaatgtgaacatctgaggattagggagtgcacagcaccgcctccaagaaacggtggcaaattttgtgaaggactgtctcaggaatcggagaattgcacagatggcttgtgtatcttggacaagaaacccctgcacgagatcaaacctcaaagcatcgaaaacgctagcgacatcgcattgtacagcgggctcggagccgcagtggtcgctgtcgcggtgttagtgattggcgtaaccctgtacagacggtcacagtcggactatggagtcgacgtaatcgacagcagcgcactgacagggggattccaaaccttcaacttcaagactgtgcgccagggcaattctctgctgttaaacagcgccatgcagcccgacttgacagtgtcacgcacgtatagcgggcctatttgtttgcaagatcctctggacaaggaattgatgaccgaaagctcattattcaacccactgtccgacataaaggtgaaagtacagagctcatttatggtttcacttggcgtcagtgaacgggcagagtaccacggcaaaaatcattctcgaaccttcccccacggcaataatcattcatttagcacaatgcacccacggaacaagatgccgtatattcagaatctgtctagcttgccgaccaggaccgagttgcgtaccaccggtgtcttcggccacctgggcggacggctcgtgatgccgaataccggggtctcgctactgattcctcacggagccataccagaggagaatagttgggaaatctacatgagcataaatcagggggagccctcactacagagcgatggcagcgaagtgctcctgtcgccagaggtcacctgtgggcctcccgacatgatagtaaccacacccttcgctttgaccatcccccactgcgcagatgtgagcagtgaacactggaatattcacctcaagaagagaacacagcagggcaaatgggaagaggttatgtctgtagaagatgaatcaacgtcctgttactgcctcctcgacccttttgcttgccatgtcctgctggactccttcggcacttacgcactcaccggagaaccaatcaccgattgcgctgttaaacagttaaaagtggcagtttttggttgcatgtcctgcaattccttggactacaacttaagagtgtactgtgtggataataccccttgcgcatttcaggaggtcgtgagcgatgagaggcatcaaggaggccagctgctggaggaacccaaacttctgcattttaaggggaatacatttagtcttcaaatctcagtgttggacatcccaccatttttgtggcggatcaaaccctttaccgcttgtcaggaggttccattttcaagagtctggtgttcgaataggcagccactgcattgtgcattctcactcgaacgatacactccaaccacaacccaactgagttgcaagatctgtattcgacagctgaaaggccacgagcagattctgcaggtacagacgtcaattctggaatccgagcgggaaacaattacgttttttgctcaggaggattccacctttcctgcccaaactgggcctaaagcctttaaaatcccgtactccatcagacagcggatctgtgccaccttcgatactcctaacgccaaaggcaaggactggcagatgttggctcagaaaaactctataaatcggaacctgtcctactttgctacccagagtagccccagtgccgtgatactgaatttgtgggaggcacgccatcagcacgacggcgatctggactccctcgcgtgtgcacttgaggagatcgggagaacccatactaagctgtccaacatctccgagtctcaactggacgaagcagactttaactattccagacagaacgggttgtag

SEQ ID NO: 55810 - DNA, 780 bp, Artificial Sequence
  Description of Artificial Sequence: Synthetic coding sequence
atgttaccctcgacctcagtgaactccctcgttcaaggtaacggcgtccttaattctagagatgcagcccgacacaccgccggtgccaagaggtacaaatacctaaggagactgttcaggtttcggcagatggatttcgaatttgccgcttggcagatgctgtacctgtttacctccccacagcgggtctatcggaactttcactatcggaagcaaactaaggatcaatgggcgagggacgatcctgcattcctcgttcttttatccatttggctctgcgtgagtacaatcggcttcggttttgtgctggacatgggattttttgaaaccattaaactcctgctttgggtggtgcttattgactgcgtgggagtagggttgctcatagccactctgatgtggtttatctctaataagtacctcgttaagagacaatccagagactatgatgtggagtgggggtacgcatttgacgtgcaccttaatgccttttaccccctgctcgtcattctccacttcattcaattgtttttcatcaaccacgtgatattaacagacacattcatcggctacctggtcggtaacaccctttggcttgtagccgtgggttattacatctacgtgaccttcctcggatactctgctctgcctttcctaaagaatacagtgatcttgctgtatccatttgccccactgattctgctgtatggcctgtctttggctttgggatggaatttcacccatacactctgttcattttacaagtaccgggtcaaatag

SEQ ID NO: 55811 - DNA, 831 bp, Artificial Sequence
  Description of Artificial Sequence: Synthetic coding sequence
atgttcttacagaatacttgtaagaggaacgttttcctgccctctaggaagatgctgcccagcacctctgtgaatagcctcgtgcagggcaacggcgtccttaactcaagagacgccgctcgccacactgccggtgcgaagcgttataagtacttgcgcaggctgttcagattccgacagatggacttcgaatttgccgcttggcagatgctgtatcttttcacaagccctcagcgtgtgtaccgcaacttccactaccgcaagcagacaaaggaccagtgggcacgtgacgaccccgcatttctggtgcttctctctatctggctttgtgtgtccactattggattcggtttcgttctggacatgggatttttcgagacaatcaaattgctgttgtgggtggtgctcattgattgtgtgggcgtgggcctcctaattgccaccctgatgtggttcattagcaataagtacctcgtcaagcgccagtccagggattacgatgtggagtggggatacgcgttcgacgtgcacctgaatgccttctatccgctactggtgatcttgcactttattcagcttttcttcatcaatcacgtgatcctcacagacacttttataggttacctcgtggggaacaccctgtggcttgttgctgtaggatattacatctacgtgaccttcctgggttacagtgctctcccctttctgaaaaacaccgtcatactgttatacccttttgccccactcatcctgctgtacggtctttctctagccctaggttggaacttcacacacaccctgtgtagtttttacaaatacagagtcaagtag

SEQ ID NO: 55812 - DNA, 831 bp, Artificial Sequence
  Description of Artificial Sequence: Synthetic coding sequence
atgttcttgcagaatacctgcaagagaaatgtgttcctaccgagccgtaagatgctgccaagcacttctgtaaactcgctggtgcaaggtaatggagtcttgaactctcgggacgctgccagacacactgctggcgctaagaggtacaagtatctgcggcgactgtttcgttttcggcagatggattttgagttcgctgcctggcagatgttgtatctttttacatccccccagcgcgtgtatcggaattttcattaccgaaagcagacaaaggaccagtgggctagagatgatcctgccttcctcgttctgttatccatttggctatgcgtctcgacaattggcttcggctttgtcctcgatatgggcttttttgaaaccatcaagcttttgctgtgggtcgtgctgatagactgcgtcggagtggggctgctgattgctacacttatgtggttcatctccaataagtacctcgtgaagcggcaatcccgggattacgatgtggagtgggggtacgccttcgatgtgcacctcaatgcattttatcccctgctggtcatcctgcatttcatccaacttttcttcataaatcacgtgattctcaccgacacatttatcgggtacctcgttggcaataccctttggctggtcgctgtggggtactacatatacgttacgtttctcgggtacagcgccctgccctttctaaagaacaccgtcatactactctaccccttcgccccattgatactgctgtacggtctgtccctcgcgttagggtggaacttcactcacacactttgctcattctacaagtaccgcgttaaatag

SEQ ID NO: 55813 - DNA, 3111 bp, Artificial Sequence
  Description of Artificial Sequence: Synthetic coding sequence
atggaggtcgtcggcgatttcgagtactcaaaacgggacctggtcgggcacggcgcatttgctgtggtatttagagggagacaccgccaaaagacggattgggaagtagccatcaagagcattaataaaaagaatttgtctaaatctcagatacttcttgggaaggagatcaagattttaaaggagttgcagcacgagaacatcgtggcactatatgatgttcaggagctcccgaattcagtgttcctggtcatggaatactgtaacggtggcgatctagccgactatctgcaggccaaaggcacgctgtcagaagataccatccgggtatttttgcatcagattgctgcggctatgaggatactacacagcaagggcattattcaccgtgacctgaaaccccagaatatcctgctgtcctacgcgaatcgccgtaaatcttctgtaagcggaatccggatcaagattgctgactttggcttcgcgagatatctccacagtaacatgatggctgccactctttgcggttcacccatgtatatggctcctgaggttattatgtcacagcactacgacgcgaaagctgacttgtggtccatcggaactgtgatctatcagtgcctagtcggtaagccaccttttcaggcaaactccccacaggacctgcgcatgttttacgagaagaacagaagccttatgccctccattccgcgtgagacatccccctacctggccaacctcctcttaggcctgctgcagcgaaaccaaaaagatagaatggattttgaggcattcttttcccacccattcctggagcagggcccagtgaagaaaagttgccccgtacctgtccccatgtacagtggcagcgtatcaggatccagttgcggatcttctccgtcctgtcggtttgcaagtcctccttccttgcctgatatgcagcacatccaggaagagaatttatccagccccccactgggaccaccaaattatctccaggtgtcgaaagattctgcttctacgtccagcaagaattcatcctgtgatacagatgactttgtgcttgtcccacacaatatctcctccgaccactcctgcgatatgcctgtgggaaccgcgggacggagggccagtaacgagtttctcgtctgcggcggtcaatgtcaacctactgtcagccctcacagtgagacagcccctatcccagtgcctacacaaatcaggaactatcagaggattgaacaaaacctgacatcaacggccagcagtggcactaacgtgcatggatctcccaggtctgctgtggtccgcaggtcaaatacatccccaatggggtttctgagacccggttcttgcagcccagtccccgctgacacagcccagaccgtgggacgtagactgtcgaccgggtcatctagaccgtatagcccatcgccattagtgggcacgatccctgaacagttctcccagtgctgttgcgggcacccccaggggcacgatagccgatccaggaattcctccggctcccctgtgccacaggctcagtccccacaatctctcttaagcggcgcacggttgcaatctgctcccactctgacagatatttaccagaacaaacaaaagctgagaaagcagcacagtgacccggtctgtccaagtcacactggagccggatatagctacagccctcaacctagcagaccgggatctctgggcacaagtcccaccaaacacctgggcagttctccccgttcaagtgattggttttttaagacccccctccctaccatcatcggatctcccacgaaaactaccgcgcctttcaaaatccccaaaactcaagctagctctaacttgttggctctagtgactcgccacggccctgctgaggagcaatctaaagacggaaacgaaccacgcgaatgcgctcattgcctgctcgtccaggggagcgaaagacagagagcagaacaacagtccaaggccgtatttggcagaagcgtcagcacaggaaaactttccgatcaacaggggaaaacccctatatgtagacaccaaggaagcacagattctctgaacacagaacgcccaatggatattgctcccgctggcgcttgtggcggtgtgttggccccaccagcgggtactgcggcttcgagcaaagccgtgctatttaccgtaggcagtcccccacacagtgccgcagctccaacctgcacgcacatgtttttgcggaccaggaccacttccgtgggcccttctaatagtgggggatcattatgtgccatgtcaggacgagtgtgtgttgggagtccacccggacctggctttggttcctcgccacctggagcagaggcggcaccttccttgcgctatgtgccgtatggagcgtctcctccttctttggaagggctgatcactttcgaggctcccgaactgcctgaggagactctgatggagcgggagcacaccgatacactccgccatcttaatgtgatgctgatgttcaccgagtgtgtactagatctgactgccatgaggggtggtaatcccgaattatgtacgtctgcagtcagtctctaccagatccaagaatcagtcgtggtggatcagatctcccagctgtctaaagactggggaagagtggagcagcttgtcctgtacatgaaggctgcgcaattgctcgccgcatctttgcacctggccaaagctcagattaaatcaggcaagctcagcccgagcacagccgtgaagcaggttgtgaagaatctcaatgagaggtacaaattttgtattacgatgtgcaaaaagctcacagaaaagctgaatcggttctttagcgacaaacagcggtttatcgacgagatcaacagcgtgactgctgaaaagctaatctataattgcgcagtggaaatggtgcagagcgccgctctagatgagatgttccaacaaacagaagacatcgtgtatagataccataaggcggcactgcttctcgaagggctttccagaatcctgcaggatcctgccgatattgagaatgtgcacaaatacaaatgcagcatcgagaggagactgagcgccctttgtcactctactgctaccgtctag

SEQ ID NO: 55814 - DNA, 3111 bp, Artificial Sequence
  Description of Artificial Sequence: Synthetic coding sequence
atggaggtggtgggtgattttgaatattccaagcgggatttagtagggcacggtgcatttgcagtagtcttcagaggcagacaccgccagaagacagattgggaggttgcaatcaagagcatcaataagaaaaatttatcaaagagccagattctactcgggaaggagattaaaatcctgaaggaattgcaacatgaaaatatagtggccctgtacgatgtccaagagctgcctaactctgtcttcctggtgatggagtactgcaacggtggtgatttggccgactacctccaggcaaagggtaccctgtcagaagacaccatacgggtgtttctacatcagattgcagctgcgatgagaatcctgcacagcaagggaatcattcatagagacttgaaaccgcagaatatcctgttatcatacgcaaatagaagaaagagctccgtttccggaatacgtattaagattgccgatttcgggttcgcgaggtacttgcattccaacatgatggccgctactctgtgcgggtctccaatgtacatggcgcctgaggtcataatgagtcaacactacgatgccaaggcagatctgtggtcaatcgggaccgtgatttaccagtgtttagtggggaaaccaccctttcaagcgaactctccacaggacctgagaatgttttatgaaaaaaaccggagcctgatgccctcaatacctagggaaacgagtccctacctcgctaacttgcttctggggctactacaacgcaatcaaaaggacaggatggactttgaagccttctttagtcacccttttctggaacagggtcctgtgaagaagtcatgtcctgtgccagtacccatgtatagcgggtctgtatccggctctagctgcggttcctcccctagttgtcgatttgcctcccctccttccttgcccgacatgcagcatatccaggaagagaatttaagttcccctcccttgggcccacctaattaccttcaggtgtctaaggactccgcctccaccagctccaagaactccagctgtgacacagacgacttcgtcctggtcccccataatatctcctctgaccacagctgcgatatgccagttggcaccgccggaagaagagcctcaaacgagttcctggtgtgtgggggacagtgccagcctaccgtgtctcctcatagcgagaccgctccaataccagtccctacccagatccgaaattaccagaggatcgaacaaaacctgacttctacagcttctagcggcaccaatgtgcacggaagccctcggtccgcagttgtgaggaggagtaatactagtcccatgggattcctcagaccaggttcatgtagtccggtcccagccgataccgcgcagacggttggcagacgactctcgacagggtcctccagaccctactctccaagccccctggtaggtacaatcccggaacagttctcacagtgctgctgtggccacccgcagggccatgattctaggagcagaaatagttctggcagtccggtgcctcaggcccagagtccacagtccctgctgtctggggctcggctccagtcagcccctactcttactgacatttaccaaaataaacagaagctgcggaagcagcacagcgacccagtatgcccctctcacacaggggctggttatagctatagtccccagccaagccggccaggctccctggggacctctccaacaaaacatctggggagctcacctcggagctctgattggttcttcaaaacccccctgcctactattatcggctctccaactaaaactacagcaccgttcaagatcccaaagactcaggctagctccaatctgcttgccctagtgacgcgacatggacctgcagaggagcagtccaaggatggaaatgaacccagggaatgcgctcattgtttgctcgtgcaaggcagtgagcgtcagagggcggagcaacaaagcaaggcagtctttggtcgatctgtgtcaactggcaagctgtcagaccagcagggaaagacaccaatttgccggcatcaggggtctacagactcgctgaatacagaaagacctatggacatagctcccgctggggcttgcggcggtgtcctggccccacctgccggaaccgccgcaagttccaaagccgtcctctttaccgttggcagcccccctcactccgcagcagcacccacctgtacacacatgttcctgcgcacccgtaccacctccgtgggtcccagcaatagcggtgggtcactttgcgctatgagcgggagagtgtgtgtaggcagtcctcctgggccaggctttggctcatcaccccctggggcagaagctgcaccctctctacgttatgttccttacggggcatctcctccctctctagaaggactgatcacattcgaggccccagaactcccagaagagactctgatggaacgggaacacacagacacattgcgtcacctcaacgttatgctcatgttcactgaatgtgtgttagatctgaccgctatgaggggtggcaacccagagctttgcacaagtgccgtttccctgtatcagattcaggagtccgtggtggtcgatcagatcagccagctgtctaaggactggggacgagtcgagcagctcgtgttgtacatgaaggctgcgcagctccttgccgcatctctgcacctcgccaaagcacagatcaaaagtggtaaacttagccccagtactgctgttaaacaagttgtgaaaaatctgaatgagcgctataaattttgcataaccatgtgcaaaaaacttaccgagaaactgaatcgctttttctccgacaagcagcgatttatcgatgaaattaatagtgtaactgccgaaaagttgatctacaactgcgcagtggaaatggtacaatcagcggcactggatgagatgtttcaacagaccgaagatattgtgtataggtaccataaggctgcactcctgctggagggtctctctagaatcctgcaggatcccgctgatatagagaatgtacataagtacaagtgttctatcgaacggcgtctctctgcactatgtcattcgactgccactgtctag

SEQ ID NO: 55815 - DNA, 2532 bp, Artificial Sequence
  Description of Artificial Sequence: Synthetic coding sequence
atgcggcttcccgaccttaggccatggacatctctgttgctggtcgatgccgcactgctctggctgctccagggccctctcggaaccctgctgccccagggactgcccggtttatggctcgaaggcaccttgcgcttaggtgggctctggggcctgctgaaactccggggacttctggggtttgttgggacactgctgctcccactctgtttggctacccctcttaccgtgtcccttcgcgctctggtggcaggtgcttcaagggctcctcctgcccgagtcgcctccgccccttggtcttggcttcttgtcggctacggagctgctggactatcttggagtttgtgggccgtgttgtcccctccaggcgcacaggagaaagagcaggaccaagtgaataacaaagtgcttatgtggcgtctcctgaagctgagccgaccagacctgcccctgttagtcgccgcattctttttcctggtgttggcagtgttgggggagacactgatcccgcattactctggcagagtgatcgatattctgggtggcgactttgacccccatgcctttgccagcgcgattttttttatgtgcctgttttcgttcgggtccagcctgagcgccggatgtcgcggtggctgttttacctataccatgagtagaatcaatcttaggattcgggaacaactgtttagctctcttcttaggcaagatctcggttttttccaggagactaaaactggggagttaaacagcagacttagctccgacacaacattgatgtcaaactggctgccactaaacgccaacgttctcctgaggtccctggttaaggtggtcggactgtacggtttcatgctgtccatctccccaagacttacattgctcagcctgctgcacatgcccttcaccatagcggctgagaaggtgtacaacacacgccatcaggaggttctgagagagattcaggacgccgtggccagggctggtcaggtcgttcgggaagccgtgggcggactgcagaccgttagatcatttggcgcagaagaacatgaagtctgcagatacaaggaggctctcgaacaatgtaggcaactatattggcggcgagatctggaacgggcactctatcttctcgttcggagggtgctgcacctgggtgtccaaatgctgatgctttcttgtggtcttcagcagatgcaagatggcgagttaacacaaggctctctcctgtcatttatgatctaccaggagagcgtgggaagttatgtgcagacccttgtgtacatatatggtgacatgctgtccaatgttggtgccgcagaaaaggtgttctcatacatggatagacaaccaaatctgccatctcctggtactctagcacccaccaccctgcagggcgtggtgaaatttcaggatgtgagcttcgcatatcctaataggccggatagacctgtgctcaagggactcactttcactttgcgtcctggggaagtgaccgctctggtgggcccaaacggaagtgggaagtccacggttgccgcacttctccagaatttgtaccagcccaccggtggtcaggtgctgctcgatgagaagcccatcagccagtatgaacactgctacctgcattcccaggtcgtgagcgtcggccaggagccagtgctgttttctggcagcgtccgaaacaacattgcgtatggcctccagagctgcgaggatgataaagtgatggccgctgcgcaggccgctcacgccgatgactttatccaagagatggagcacggcatatatactgatgttggtgaaaagggatcacagttggccgcagggcagaagcaacgactggctatagccagggccttagtgcgagatccccgtgtgttaatcctggacgaggcaaccagcgcgctggatgtgcaatgtgaacaggccaatggcttttgggttgggccactaggagggggaagcgcaagcgagagcgatccaacaggattcttacacgattctcgacatcgattatccagtgatgtagggatgtttgtggccttgacaaagctcggccagccagatgcagaacagtggaacagccgactcgacctcctggagaggagcaggcaggctgtcgacggcgtttgtaggcacaattatcggctgggagcccctttcaccgtgggacggaaggtccaacccgaggtgaccgtgtaccctgagcgtacaccattactacaccagcataacctgttgcattgctctgtgactggattttatcccggtgacatcaagataaagtggttcctaaatggccaggaggaacgggcaggggtgatgtcgactggccctatacgaaacggggattggacgtttcaaaccgtggttatgcttgagatgacgcctgaactggggcatgtgtatacatgcctggttgatcacagttctctgctctcgccggtcagtgtcgagtggcgggctcagtctgagtacagctggcgcaagatgctgtcagggattgctgccttcttgttgggcttatag

SEQ ID NO: 55816 - DNA, 2247 bp, Artificial Sequence
  Description of Artificial Sequence: Synthetic coding sequence
atggaccagcatcagcacctgaacaagaccgccgaaagcgcttccagtgaaaaaaaaaagacccgacggtgcaacggtttcaagatgttcctcgccgctctaagtttctcctatatcgctaaagctctgggcggaataatcatgaagatctccattacgcagatagagcgcaggttcgacatctcatcgtcactggccggtcttatcgatggatcctttgaaattggtaacttacttgtcatcgtttttgtgtcatacttcggcagcaagctgcaccggcctaagctgatagggataggctgtctgctgatgggaaccggctccattttaacaagccttccccacttcttcatgggctactaccgatactcaaaagagacccacatcaaccctagcgagaattccacctcttccttgtctacttgcctcatcaatcaaaccctgagcttcaatggaacaagtcctgagatagtggaaaaggactgcgttaaggaaagcggttcacacatgtggatttatgtctttatgggcaacatgttaagaggcataggtgaaacccccatcgtacctctcggcataagctacattgatgattttgccaaggaggggcacagctccttgtacctgggaagcctgaacgcaattggaatgattggaccggtgataggttttgctctgggaagtctgtttgctaagatgtacgtcgatatcggctacgttgatctgagcacaattcggatcacacccaaagattcccgctgggtgggcgcatggtggctagggttcctcgtgtctggcctgtttagtataatatcttcaatcccatttttctttcttcctaagaatcccaacaagccacagaaggagcgaaagatttctctgagcctacatgtgctgaagacaaacgatgaccggaatcagacggcaaacctgaccaaccaaggcaagaacgtaacaaagaacgtgaccggctttttccagtctctgaagtctatactcactaatcctctttacgtaatattcttgctgcttacactccttcaagtgagctcctttatcggatcctttacttatgtcttcaagtacatggagcaacagtacgggcagtctgcctcacacgctaattttcttctcggcataattacaatccccactgtggccaccggcatgttcctagggggattcattatcaagaaattcaaattgtctttagtgggcatagcaaagttttcgtttctcacatcaatgatctccttcctcttccaattgctctatttccccctgatctgcgagtccaaatctgtcgccggtttgaccctcacatacgatggaaataatagcgttgcgtcgcatgtcgatgtgccactgagctattgtaactccgagtgtaactgcgatgagagccagtgggaaccagtgtgcgggaataacggaatcacctacctgtctccttgtctggcaggatgtaagagctctagtggcatcaaaaaacacactgtgttctataactgttcctgtgtcgaagttaccggccttcagaaccggaactattcagcgcacctcggagagtgcccccgagataacacttgtaccagaaaattctttatttatgtggcaatccaagttattaattccctcttttctgccacaggcggtacaacattcatccttttaacagtaaagattgtgcagccggaactgaaagccctcgctatgggttttcagagcatggtgatacgcaccttaggcggtatcctggcccctatctacttcggagctctcattgataagacttgtatgaagtggagtaccaactcctgtggggcacagggcgcatgcaggatctataattcagtgttctttggcatcgtccagccggaactaaaagcactggccatcggcttccatagcatgatcatgagaagcctgggaggcatcctggtccctatttatttcggagccttgatcgacaccacctgcatgaagtggtctaccaactcttgcggagcccgtggcgcttgccgcatctataattccacttatcttggccgagccttcttcggactgaaggtcgctctcatattcccagttctcgtgttgctgaccgtgtttatctttgtggtacggaagaagagtcacgggaaagacactaaagttctggagaatgagaggcaggtgatggacgaagccaacctggaatttctcaatgattccgagcatttcgtcccctcagccgaggagcagtag

SEQ ID NO: 55817 - DNA, 582 bp, Artificial Sequence
  Description of Artificial Sequence: Synthetic coding sequence
atgagtccttgtggcggagaggatattgtagcggaccatgtcgctagctatggcgtaaacctttaccaatcatacggtccatcaggacagtacacccatgagttcgacggcgatgagcagttttacgtcgatcttgggagaaaggagacagtttggtgcctccccgtgctgagacagtttcggtttgacccacagtttgcacttacaaacatcgccgttctgaagcataatctcaattccctgatcaaacggtccaatagcaccgccgcaacaaacgaggtgcccgaagtcacagtgttctccaagtctcccgtgactctgggacaacctaatatccttatttgtctcgtggacaatatctttccaccagtggtcaatataacttggctttccaacggacacagcgtgactgaaggtgtgtcagaaacatcattcctctccaagtcagatcatagttttttcaagataagctaccttactcttctgcctagcgcagaagagtcatacgactgtaaggtggagcattggggtctcgacaaaccccttttgaagcattgggtgcatgggttcctatcattttag

SEQ ID NO: 55818 - DNA, 762 bp, Artificial Sequence
  Description of Artificial Sequence: Synthetic coding sequence
gggtgtctcgggaagcgaatgattctcaataaggccctgatgctcggggcacttgccctgactaccgtgatgagcccttgcggcggtgaagacatagtagcagatcacgtcgcatcctacggcgtgaacctgtatcaaagctacggaccctcaggccagtatacacacgagtttgatggagacgagcagttttacgttgacctcgggagaaaagaaactgtttggtgcctcccagtcctcaggcagttccgctttgatcctcaatttgccctgactaatattgccgtgctcaagcacaacctcaactctctgattaaacggtccaattcaaccgccgctaccaacgaggtgccagaggttacggtcttctctaagtcacccgttaccttgggccaacccaacatccttatctgtctcgttgataatatttttccaccagttgtaaacattacatggctaagcaatgggcatagcgtgacagagggtgtgagcgagacttcttttctgtcgaaatccgaccatagctttttcaaaatcagctacctgactctgctgcctagcgccgaggaaagctatgattgcaaggtggaacattgggggctcgataagcctctgcttaagcattgggggaaagacgagttccatcacttcctgatgctttcatgtctcagctccagtgaattgccagccttctacagctacattccaaagctggtctttcacacttcttgggtgagcttttttttgatcttcttcttctag

SEQ ID NO: 55819 - DNA, 441 bp, Artificial Sequence
  Description of Artificial Sequence: Synthetic coding sequence
atgattctgaataaggcactcatgttaggcgcactagctctgaccactgtcatgtccccatgcggcggagaggatatcgtggcggatcacgtggcctcctacggtgtgaacctataccaaagctatggaccaagcggacagtatacacacgagttcgatggcgacgagcaattctatgtggacctgggacggaaagaaaccgtgtggtgtctgcctgtgctgcggcagtttaggttcgaccctcagtttgcccttacgaatatgtgcattgctatttataggtcgcgacgtgtggatctactccacgatcttgccttatttagtggcccaatttaccacatcccctttttgctgcagatgttcctactgagtccgttgttgtgggacctcaactgttacatctgttctgagctcaccaatgcttttgaactgtttccatag

SEQ ID NO: 55820 - DNA, 765 bp, Artificial Sequence
  Description of Artificial Sequence: Synthetic coding sequence
atgatcctcaataaggctctgatgcttggtgctctcgctctgactacagtaatgtccccttgcggaggggaggacatagttgcggaccacgtggccagttatggcgttaatctgtaccagtcttacggccctagcgggcagtacacccatgagtttgatggcgatgagcagttctatgtggatctaggcaggaaggaaactgtctggtgtctccccgttttacgccagttcaggttcgaccctcagtttgcactgaccaacatagcagtgctgaagcataacttaaattccctcataaagagatcaaattcaactgctgccacaaatgaggtcccagaggtgaccgtttttagtaaaagtcccgtgacgctgggtcagccaaatatactgatctgcctcgtcgataatatctttcccccagtcgttaacatcacctggctctccaatgggcacagcgtgacggagggtgtctcagagacctcctttctgagtaagtctgaccacagttttttcaaaatttcctacctgaccctgctcccctccgccgaggagtcatacgactgcaaggtggagcactgggggctggacaagcctttgttaaagcactgggagccagagatccctgctcctatgtcggaactaaccgaaacggtcgtgtgcgcactgggactgagcgtggggttggtgggcattgtggtcggaaccgtatttatcattcgcggtctgcggagcgtcggggcatcacggcaccaagggccactatag

SEQ ID NO: 55821 - DNA, 498 bp, Artificial Sequence
  Description of Artificial Sequence: Synthetic coding sequence
atgactcgtctctgcctcccccgaccggaggctcgagaggaccccataccggtgccaccacggggacttggtgcaggcgaaggctctggatctccggtgaggcctcctgttagcacctggggcccaagctgggcccagctgcttgattctgtcctatggctcggcgctctgggccttaccatccaagccgtgttctcgacaaccggaccagcgttgctgctgttgctggtgtcctttcttacatttgatcttttacatagaccagctggtcataccctcccacagcgcaagctgttgacaaggggccaatcccaaggagctggcgaggggccaggccagcaggaagcacttctgctacagatggggaccgtgagtgggcagttgtcactgcaagacgcactcctgcttttactgatgggtcttgggcctctgcttcgagcctgcgggatgcctctgacactgctcggcctggctttctgcctgcatccctgggcttag

SEQ ID NO: 55822 - DNA, 513 bp, Artificial Sequence
  Description of Artificial Sequence: Synthetic coding sequence
atggtgacggtgctggaccagatgaaagccggtacgtacaagctcaccttcgataccgagggctactggcgcaagcggggtcaagaaagcttctacccgcatgtggaagtggtcctcacgatcacctccaaggctcaaaaatttcacgtacccttggttctgcaccacttgccacgcgagctagagcggaggctcgctgctggtgggtgtctccccgtacctgctcgttggctccatccacccagcccacagcagtccgggctatgtgcccaccaaggtgccttagcccatcatttcctcggcaagtctagacccccaggggagagccattgggccgctgtgacccaagtatcaatgaagctggtgccagcgccagcgaagttgtcgattaggtgggataactcaggcgctaaaacaggtagtactgctagacactgtcccaatcctcaggtttccgcaggacactccgagaaagtacccccaactgttgtgggcggtgagacacgcgagtag

SEQ ID NO: 55823 - DNA, 780 bp, Artificial Sequence
  Description of Artificial Sequence: Synthetic coding sequence
atggctgctagtcgcctggagctaaacctggtgcggttgttgagcaggtgtgaggccatggcggctgaaaagagggaccccgacgagtggaggctggaaaaatatgtgggcgctctggaagacatgcttcaggcactgaaggtgcatgctagtaagcctgcttctgaagtgatcaatgagtactcttggaaggttgatttcttgaagggtatgctgcaagccgaaaagctgacaagctctagcgagaaggccctcgccaatcaatttcttgcccctggcagagtgccgaccacagccagagagagggttcctgccacaaagactgttcatctgcaatcaagagccaggtatacaagcgagatgcggtccgagctgttgggaaccgacagcgccgagcccgaaatggatgtgcgcaagagaacaggagtcgctggctcccaacccgtcagcgagaaacagctggccgcagagttagatttagtgctgcagcggcatcagaacctgcaggagaaactggccgaggagatgctgggcctggccaggtcactcaagacgaataccctcgctgcccagtctgtcatcaagaaggacaaccagactttatcccattcactcaaaatggcagatcaaaatctagagaagctgaaaaccgagagcgaaagactcgaacagcatactcaaaagtcggtgaattggttgctgtgggccatgctgatcatagtgtgcttcatcttcatctccatgatcctcttcattcggatcatgcccaagctcaaatag

SEQ ID NO: 55824 - DNA, 177 bp, Artificial Sequence
  Description of Artificial Sequence: Synthetic coding sequence
atggccggtccagaatctgacgcccagtaccagtttacaggcatcaaaaaatacttcaatagttatacactaacggggagaatgaattgcgtccttgcgacatacggaagcatcgccctaattgtcttatattttaaactccgttctaagaagacgccagccgtgaaggcaacatag

SEQ ID NO: 55825 - DNA, 177 bp, Artificial Sequence
  Description of Artificial Sequence: Synthetic coding sequence
atggctgggccagagagcgatgctcaatatcagttcactgggattaaaaagtattttaattcatataccttgaccggcagaatgaactgcgtgctggcaacttacggtagcatagctctgatagtgctgtatttcaagttgaggagcaagaagacacccgcagtgaaagctacatag

SEQ ID NO: 55826 - DNA, 177 bp, Artificial Sequence
  Description of Artificial Sequence: Synthetic coding sequence
atggcagggccagagagcgatgcccaatatcaatttacagggatcaagaaatactttaatagttacacattgaccggccgaatgaattgcgttctggccacgtatggcagcattgcattgatcgttctctacttcaagctgcgctctaagaaaacccccgcagttaaagctacatag

SEQ ID NO: 55827 - DNA, 177 bp, Artificial Sequence
  Description of Artificial Sequence: Synthetic coding sequence
atggccggtccagagagcgacgcccagtaccagtttacagggatcaagaagtattttaactcctacactctgaccggcagaatgaactgcgtgctcgcgacatatggttccatcgccctgattgttctttactttaaattgcgatctaaaaaaacaccagccgttaaggctacttag

SEQ ID NO: 55828 - DNA, 177 bp, Artificial Sequence
  Description of Artificial Sequence: Synthetic coding sequence
atggctggccctgaatctgatgcgcagtatcagttcactggaatcaagaagtatttcaactcctatacgttgaccggccgaatgaattgcgtccttgccacatatgggagtatcgccctcatcgttctgtattttaagcttcggagcaagaaaacaccagcagtgaaggctacttag

SEQ ID NO: 55829 - DNA, 792 bp, Artificial Sequence
  Description of Artificial Sequence: Synthetic coding sequence
atggacaacagttggaggctgggtccggcaattgggctgtctgcgggacagtctcagctgcttgtctctctcctgctactgttgacacgagtacagcctggcactgacgtagctgcccctgagcacattagttatgtgccccagctatcgaatgacaccctcgctggaagacttaccttatcaacctttacgctcgaacagcctctcggtcagttctcttcacacaatatcagcgatctggacacgatttggctggtggtggccttgagtaacgcaacgcagtcctttacggcccctcgcacgaatcaggacatccccgcaccagcaaacttctctcagcggggatattaccttaccctgagggccaaccgagtcttgtatcagacccggggacagctacatgtgctcagggttggaaatgacactcactgtcagccaacaaagattggttgtaaccatcctctgccaggccctggcccttacagagtcaaattcctcgttatgaatgatgagggcccagtcgcagagaccaagtggtctagcgacaccaggctgcagcaggctcaggcccttcgagccgtccctggcccacaatcgccgggaaccgtagtgatcattgcgatcctttctatacttctggccgtgctactaacagtactgctggcagttctgatctatacctgtttcaatagttgtcggtctactagcttgtccggccctgaggaggccggttcagtgagacgctataccacccacttggcgttttcgactcccgctgaaggggcttcatag

SEQ ID NO: 55830 - DNA, 1170 bp, Artificial Sequence
  Description of Artificial Sequence: Synthetic coding sequence
atggccctgaccccagagagcccttccagttttcccggattggcagcgactggcagctcagtccccgaaccgccaggcggacctaatgcaacactgaatagcagttgggccagccctactgagccatcatccctcgaggacctagtggccacaggtacgattggaacgctactttctgctatgggggtggtgggcgtggtcggtaatgcatacacattggttgtgacatgccgttccctaagggccgtcgcatcgatgtacgtatatgttgtcaatctcgccctggctgacctgttgtacctgttgtccatcccttttatcgtcgctacctatgttaccaaggagtggcatttcggagacgttggctgccgcgtcctgtttgggttggacttcctcacaatgcacgcgagcattttcactctgacagtgatgagtagcgaacggtatgcagcagtcctgcgacctctcgacacagtgcagaggccaaagggctatagaaagctcttggccctcggcacctggctcctggctctgctgctgacgctgccagtgatgctggcaatgaggcttgtgcggcgagggcctaaatcactgtgtttgcccgcttggggcccacgggctcacagggcttatttaaccttgctgtttgcaacctccattgcaggcccaggccttctgatcggcctgctgtacgctaggctggctagggcctatcgacggtcccagcgcgcttcattcaagcgggctagacgcccaggggcaagggctcttagactcgtgctgggcatcgtacttcttttttgggcctgctttctgccattctggctatggcagttactggcacagtatcaccaggcgccacttgctcctcgcaccgccagaatagttaattacctgacaacctgcctgacctacggcaattcctgtgccaacccattcctttacacactcctgacccgcaactatagggaccatctgaggggccgtgtcagaggacccggatcgggtggcggacggggacctgtgccaagcttgcagccaagggcacgctttcaacggtgtagcgggagatcgctgtcttcatgctctcctcaacccacggatagcctcgtgctggctcccgctgcaccagccaggcctgctcccgagggccctcgagctcccgcatag

SEQ ID NO: 55831 - DNA, 1578 bp, Artificial Sequence
  Description of Artificial Sequence: Synthetic coding sequence
atgatgccgtggctctggactgcccctcatcagaaagagagtcagaaagccgacgagtacttacgggagattcaggagctcggtcaactcacgcaggcagtccagcagtgcatcgaggctgccggacatgaacaccaaccagacatgcagaagagcctcctacgcgttggtctagatggtcgtgctggagagggaggagccggacgaggatgggatggacaacagggctcgtcactgctgtcaccctcgggttcttctcaggctgcctcctttgggaaatgttttttggacaggttcccgccagattcatttgtgcacatgtgccaggatttaagggtacttaacgcagtgcgagactatcacatcggcattcctttaacctactcccagtacaagcaactcacaattcaagtgcttcttgaccgcttggtgctgcgtagactttatcctctggcaattcagatatgcgaatatctccgcctgcctgaagtgcagggcgtgtcccgcattctggctcattgggcctgctacaaagtccagcaaaaggacgtctccgacgaagatgtagccagggctattaatcagaagcttggcgacacccccggagtgagctatagcgatattgctgccagagcctacggctgcgggcgtaccgaattggccatcaagttgctggagtacgagccaaggtccggtgagcaagtgccacttctgctgaaaatgaagagaagcaagctcgcactgtcaaaggcgattgaatccggggacactgatcttgtatttactgtgctcctgcacctgaaaaatgagctgaaccgcggtgacttcttcatgacattaagaaatcagcccatggccttgagcttatacaggcagttctgtaagcatcaagagcttgagacccttaaagacctttacaatcaggatgacaaccaccaggagcttggctcttttcacattagggcatcatacgcggcagaggaaagaatcgagggaagggtcgccgcattgcagacagccgctgacgcgttttacaaggccaagaatgaatttgccgcaaaggccacagaggaccaaatgagactgttgcgtcttcagagaagactggaagacgaactcgggggacagttccttgatctctctctccatgacacagttacgaccttaattctgggcggacacaacaagcgcgcagagcagctggcacgagattttaggatcccggataagaggctgtggtggctgaaattgactgctctcgcagatctggaagattgggaagaactcgaaaagttcagcaaaagtaagaaaagtcctattgggtatttaccattcgtggagatttgtatgaaacaacacaacaaatacgaggccaaaaagtacgcgtctagggtgggtcccgaacagaaggtgaaagccttactgctggtcggagacgtcgctcaggccgctgatgtggccattgaacacagaaatgaagcggagctgtcactcgttctttcacattgcaccggggcaacagatggagctactgccgataagatacaaagagccagagcccaagctcaaaagaagtag

SEQ ID NO: 55832 - DNA, 2520 bp, Artificial Sequence
  Description of Artificial Sequence: Synthetic coding sequence
atggactgttacacagcgaactggaaccctctcggggactccgccttttataggaaatatgaactgtactcgatggactgggatctgaaggaggagttgcgggactgtcttgtggccgctgctccttacggaggcccaatcgcgttgctccggaacccttggcgaaaggaaaaagcagctagcgtaaggcctgtgcttgacatttacagcgcctcggggatgcctctagcctcccttctgtggaagtcagggcctgtggtgagtttgggctggagcgccgaagaagaactgctgtgcgtacaggaggacggtgctgtgcttgtgtatggtttacacggggattttaggcgtcactttagcatggggaatgaagtacttcaaaaccgagtgttggacgcacgcatttttcatactgaatttgggtccggcgtagctatattgaccggagctcacaggtttaccctctccgcaaatgtcggggacctgaagcttaggcggatgcccgaagtaccgggattacagagcgcaccttcttgttggaccgttctctgtcaagaccgcgtcgcccacatacttctggccgtgggcccagatctttacctcctagatcacgcggcatgtagtgctgttacaccccctggccttgcgccaggcgtatcatcattcctacagatggccgtgagcttcacataccgacatctggccctgtttactgacacgggttacatctggatgggtaccgcctctctgaaagaaaaattgtgcgaattcaattgcaatattagggcccctcctaagcagatggtgtggtgctctagacctcgtagcaaggaaagggcggtcgtagtagcctgggaaagacgccttatggtggtgggggatgcccctgagagcatccagttcgtgcttgacgaggactcatacctggttcccgaactggatggtgtgcgcatcttcagcaggtcaacccatgaattccttcacgaagtgcctgccgcatctgaggagattttcaagatcgcatcaatggccccaggagccctgctgcttgaggcccagaaggagtatgaaaaggaaagtcaaaaggccgatgagtacctaagggaaatccaggaattgggtcagcttactcaggctgtccaacagtgcatcgaagccgctggccatgagcaccagcccgacatgcagaaaagtctgctgcgcgcagccagctttggaaagtgttttttagataggtttcctcccgactcatttgtgcacatgtgtcaggaccttcgggtactgaatgcggtgcgagattaccacatcggtatacccctaacttattcccagtacaagcaactgacaattcaggtccttcttgaccggctagtcttgcgaagactgtatccgttggccattcaaatctgcgaatatctgcggttacccgaagtgcagggtgtgtctcgcatactcgcacactgggcatgctacaaagtccaacaaaaagacgtcagtgacgaggatgtagctcgggcaatcaatcagaagcttggagacacaccaggagtgtcatactccgatatcgctgcgagagcatatggctgtggcaggaccgaactggctatcaagcttcttgaatacgaacccagaagcggagagcaggtgccgttgttattgaaaatgaaaaggtcaaagctggcgctctctaaggcgatcgaatctggagacactgatctcgtgtttacggtgcttcttcatctgaaaaatgaattgaataggggagatttttttatgactttgcgcaatcaacctatggctttgtcactataccgtcagttttgcaaacaccaggagctggaaactctgaaagacctctacaaccaggacgacaaccatcaggagctgggatcgtttcatatccgagcctcatatgctgctgaggaaagaattgagggacgcgtcgcagcccttcagaccgcggcagatgccttctataaggctaagaatgagtttgccgctaaagcaacggaggaccagatgagactcttgaggctgcagagacgcctcgaggacgaactcgggggacagttcctcgatctctccttgcatgataccgtcacaactttaatcctgggagggcacaataaaagagccgaacagctagccagagacttccgcatcccagataaacgattgtggtggctgaagcttacagccctggctgaccttgaagactgggaagagcttgagaagttttcgaagagcaagaagtcgccgatcgggtacctgcccttcgtcgaaatatgcatgaagcagcataacaagtatgaggctaagaaatacgccagccgggtcgggccagaacagaaagtgaaggcgctcctgctggtgggtgacgttgcccaagcagccgatgtggctatcgaacaccggaatgaggctgaattaagccttgtgctgtcccactgtaccggggctacagatggagccacagccgacaagatccaacgcgcacgcgctcaggcccagaaaaagtag

SEQ ID NO: 55833 - DNA, 2088 bp, Artificial Sequence
  Description of Artificial Sequence: Synthetic coding sequence
atggactgctacacagccaattggaatcctctgggagactctgctttttataggaaatacgagctgtacagcatggactgggatctcaaagaagagctccgcgattgtctcgtcgcggcagccccatacggcggtcctatagcccttcttcgcaacccatggcggaaggagaaagctgcgtccgtgaggcctgtattggacatttactctgcatctgggatgcccttggcatccctgctgtggaagtcaggaccagtcgtttccttgggctggtccgccgaggaagagcttttgtgtgtgcaggaggatggcgctgtcctcgtatacggcttgcacggggattttagacgccatttctccatgggaaatgaggtcctgcagaacagagtcctggacgcacgcattttccatacagaattcggcagcggagtggcgatactcactggcgcacaccggtttaccctgtcggctaatgtgggcgacctgaagctccgcaggatgcccgaggtacccggtcttcagtcagccccatcgtgttggactgtgctttgtcaagatagggtggcccacatactcctagctgttggccctgacctttatctactagaccacgcagcttgtagcgccgtgacaccaccagggctggccccaggcgtgtcctccttcctgcaaatggctgtctccttcacctaccgccacctggctttattcactgacaccgggtacatctggatgggtactgcatctctaaaggagaaactgtgtgaatttaattgcaacattcgcgctccacccaagcaaatggtatggtgtagcagaccacgcagtaaagaaagggcagtggtggtggcatgggagcgccgactcatggtggtcggcgacgcacccgagagtatccagtacaaacagctcaccatccaggtgctcctggatcgcctggtactgaggaggctgtaccccttagctattcagatatgcgagtatctgagacttcctgaagttcagggtgtcagtagaatcttagcccactgggcctgctacaaggtacagcagaaggatgtaagcgatgaagacgtggctcgtgccattaatcagaagctgggagacacacccggagtatcctactcagacattgctgctcgcgcttatggctgcggcaggacggagctggcaattaaactgctggagtacgaacctaggagcggggaacaagtccctcttctactcaagatgaagcgctccaagctggccctgtcaaaggccatcgagagcggcgacacggacctggtttttacagtgctcctgcatttgaaaaatgaactcaaccgcggtgattttttcatgaccctcagaaaccagccgatggccctgagtttatatcgacagttttgtaagcaccaggagttggagactctgaaggacctttataatcaagatgacaaccatcaggaattgggttcctttcacatccgggcttcatatgcagctgaggagcgcatcgaaggccgagtcgccgctcttcaaactgcagcagatgctttctacaaagcaaagaacgaattcgccgctaaggcaactgaagatcagatgcgcctcctgaggctacagcgccgattggaggacgaactcggtgggcagttcctagatctatctctgcatgatacagttacaacattgatccttgggggtcacaataagcgagcagaacagcttgcacgcgatttccgtatccccgataagcgcctgtggtggctgaaactgactgcgcttgccgacctggaggattgggaagagcttgagaagtttagcaaatctaaaaaaagccctattggctacttgccatttgttgagatttgcatgaagcagcacaataaatatgaggccaaaaaatacgcctcccgggtgggcccagaacagaaagtcaaagcactgctactcgttggcgatgtcgcacaggctgcagatgtcgcaatcgaacaccgcaacgaggcagaacttagtcttgtcctgtcccattgcactggagctacagatggcgcaacggccgacaagattcaaagggccagagcccaggcacagaaaaaatag

SEQ ID NO: 55834 - DNA, 684 bp, Artificial Sequence
  Description of Artificial Sequence: Synthetic coding sequence
atgggtgcccctttggaggtcctgcagaaccgagtgctcgacgcccgtattttccatactgagtttggtagtggagtggctattctgactggggcacatagatttacactgagcgcaaacgtgggcgatctgaaattgagaagaatgcccgaggtccccggactccaatccgcgccttcttgctggactgttttgtgtcaggacagggtcgcacacattctgctagcggtcggaccagacttatatcttctcgaccacgctgcatgctccgccgtgacaccaccgggtctggctccgggagtgtcatcgttcctgcaaatggccgtgtccttcacctatcggcaccttgctctgttcactgacactggatatatatggatgggaaccgcctctctaaaggagaagttgtgcgaattcaattgtaacataagagctccccctaagcagatggtgtggtgctctaggccgagaagcaaggagagggctgttgttgtagcctgggaacggcgactgatggtggtgggggacgctcccgaatctatccagtttgtactggatgaagacagctatctagttccagagctcgacggcgtgagaatattttcccgtagtacacatgagttcctgcacgaagttccagccgcatccgaggaaatatttaagattgcgtctatggctccgtag

SEQ ID NO: 55835 - DNA, 825 bp, Artificial Sequence
  Description of Artificial Sequence: Synthetic coding sequence
atgggcgcacccttggaagtgctgcagaatcgcgtcctggacgcacggatttttcatacagagtttggcagcggcgtcgccatcttgacaggggctcacagatttacgctgagcgcgaatgtcggagacctgaagttgaggcgaatgccagaggtgcctggcctgcagagtgcaccttcctgctggaccgtactctgtcaagaccgcgtagcgcacattctcttggctgtcggcccagacctctatctgctcgatcacgcggcttgttctgccgttactcctccagggctcgcacccggagtgtcctctttcctccagatggctgtgtcctttacatacaggcacctggctctttttactgatacaggatatatctggatgggtacagcctctctgaaagagaagctttgtgaatttaattgcaacattcgagctcccccaaaacagatggtttggtgctcacgaccccgaagcaaggagcgcgcagtggtggtggcctgggaacgtcggctcatggtcgtaggggacgccccagaaagcatacagtacaagcagctgaccattcaagttttactggatagactagtattacgacggctctaccccctagccatccagatctgtgaatatctcagacttcccgaggtccaaggggtgtccagaatccttgcgcactgggcttgttacaaagttcaacagaaggacgtgagcgacgaagacgtggctagggcaatcaaccagaaacttggagacacccctggagtcagttactcagacattgccgctcgcgcttatgggtgtggaaggaccgagttagcaatctag

SEQ ID NO: 55836 - DNA, 711 bp, Artificial Sequence
  Description of Artificial Sequence: Synthetic coding sequence
atgcctcccagggagctcagcgaggccgagcctcctcctctgagagccccaacgccccctcctagacgtcggagcgctccaccagaactgggtattaagtgcgtcttggtgggagacggcgctgtgggaaagagcagtctgattgtaagttatacgtgcaacgggtaccccgcaagatatcgccctaccgcattagacacatttagtgtgcaggtcttagtagacggcgctcctgtgcgcattgagctgtgggatactgctggtcaggaagattttgatcgtctgcgcagcctgtgctaccccgatacagatgtgttcctggcatgcttctccgttgtgcagcctagtagtttccagaatatcacggagaagtggttgcccgagatccgcacccacaaccctcaggctcccgtactcctcgttggaacacaggctgaccttcgagacgacgttaatgttcttatccagttggaccagggcggtagggaaggacccgttccccaaccccaagcccaggggctggcagaaaagataagagcttgctgttatcttgagtgcagcgccctgacgcagaaaaacctgaaagaagtctttgactctgccatcctgtcagccatcgagcacaaggccagactggagaaaaaattgaacgctaagggagtgcgcacactatcccgctgtaggtggaagaaattcttctgctttgtgtag

SEQ ID NO: 55837 - DNA, 561 bp, Artificial Sequence
  Description of Artificial Sequence: Synthetic coding sequence
atggccggtcaccgtcttgtgttagtcctaggcgatctgcacataccccatcgatgtaacagtctacctgccaagttcaagaagctgctggttccgggaaagattcagcatatcctttgtaccgggaacctgtgcaccaaagagtcatatgactatcttaagactttagcgggtgatgtccatattgtgagaggcgacttcgacgaaaatctgaactatccagagcaaaaggtcgtgacggtgggacagtttaagataggccttattcatggacaccaagttatcccatggggagacatggcgagtctagcccttctgcaacgacagttcgacgtggacattctgatctccggccacactcacaagtttgaggcattcgagcatgagaacaagttttacatcaaccccggttcggctactggggcttacaacgccctggaaacgaatatcatcccttctttcgtcctgatggacattcaagcaagtaccgtggttacctacgtttatcaactcattggggacgatgttaaggtggagaggattgaatataaaaaaccttag

SEQ ID NO: 55838 - DNA, 264 bp, Artificial Sequence
  Description of Artificial Sequence: Synthetic coding sequence
atggcgtcgctggctctgctccagagacagttcgacgttgacatccttatctctggccatactcataagtttgaggcattcgaacacgaaaacaagttttacatcaatccagggagtgccacgggcgcttacaatgccctggaaacaaacatcatccccagcttcgttctgatggacatacaggcgagtaccgtggtcacctacgtgtatcagttgatcggagatgacgttaaggtcgagcgtatagagtataagaagccctag

SEQ ID NO: 55839 - DNA, 549 bp, Artificial Sequence
  Description of Artificial Sequence: Synthetic coding sequence
atgctcgttctcgtgcttggggatctgcatatcccacacagatgcaactcccttccagccaagttcaagaagcttttggtgccgggaaagatccagcatattctatgtaccggtaatctctgtaccaaagaaagctacgattaccttaagacacttgccggagacgtgcatatcgttcgcggagacttcgatgagaacttgaattatcctgagcagaaagtggtaaccgttggacagtttaagattggacttattcatggtcatcaagtaattccctggggagacatggcatccctggcgctgctgcaacgccagtttgatgtcgatattcttattagtggccatacacacaaatttgaagctttcgaacatgagaacaagttttatatcaatccaggctcagctacaggcgcatataacgctctcgaaactaatattatcccttctttcgtcttgatggacatacaggcctctacagtcgtcacctatgtttaccaattgattggtgacgatgtgaaagtagaaagaattgaatacaagaaaccctag

SEQ ID NO: 55840 - DNA, 2172 bp, Artificial Sequence
  Description of Artificial Sequence: Synthetic coding sequence
atggccgcagcggcaactatggcagcagcggctcgcgagttagtgctgagagctggaacgagcgatatggaagaggaggaagggccactggcaggaggacctggcttgcaagaacctctgcagctgggtgaactggatattaccagcgacgagtttattctggacgaagtcgacgtacacattcaggccaaccttgaagacgagctcgttaaagaggcattaaaaactggggtcgatttacgacactattccaaacaggtggaacttgagctgcaacagatagaacagaagtctataagggattacattcaggagtctgaaaacattgcgagtttacataaccagataactgcatgtgatgcagttctagagagaatggagcagatgctgggtgccttccagagtgatctaagcagcatctcatccgagatccgcactctccaggaacagtctggggcaatgaacattaggctgcgcaacaggcaggcagtcaggggcaagttgggagaattggtggacggactagttgtcccctcagcgctggtgactgctattctggaagcaccagttaccgaacctcggttcctggaacagttacaggagctggacgctaaagccgcagccgtgcgcgagcaggaagctaggggaacggcggcatgcgccgacgtgcgcggagtcttagataggctccgggtgaaagcggtcacaaagataagagaattcatactgcagaaaatttatagctttaggaagcctatgaccaattatcaaatcccccagaccgccctgctgaagtataggttcttttaccaattcctcctcgggaacgagcgggctaccgccaaggaaattagagacgagtacgttgagacactgtctaaaatctacctgtcctactaccggagttacctgggtaggctcatgaaggtccaatatgaggaggtggccgaaaaggatgacctgatgggcgtggaagacacagccaaaaaaggattttttagcaagccatcgttgcgctctcgtaacacaatttttaccctgggcacacgaggctcagtgatctctcctactgagctggaagctccaatcctagtgcctcacaccgcccagcggggtgagcaaagatatcctttcgaggcactttttaggtcccagcattacgcactgctggataatagttgtagggagtacctattcatctgtgagttcttcgtagttagcggacctgccgcacatgatcttttccacgccgtgatgggacgaacgctatccatgaccctcaagcaccttgattcatatcttgccgactgctatgatgccattgccgttttcctgtgtatccatatagtgctcaggttcagaaacatcgccgcaaagcgagacgtgcctgccttagacaggtactgggagcaagtgctggccctgttgtggccacgattcgagttgatcttggaaatgaatgttcagtccgttcgctcaacagatccccaaagactgggaggccttgacaccaggccccactacattaccaggcggtacgctgagtttagcagcgccttggtcagtataaaccagacgatccctaacgagcgaaccatgcagctactgggccagctccaagtggaggtagagaatttcgtgttaagggtggccgctgagttctcgtccagaaaagaacagctggtgtttctgattaataactatgacatgatgcttggagtactcatggaaagagcagccgatgattccaaggaggtcgagtcctttcagcaactactcaacgcaagaacgcaggagttcatcgaggagctcctgtcgcctcccttcggcggtcttgtagctttcgtgaaggaagccgaggctctgattgagcgaggtcaggcagagagattgagaggcgaggaagccagagtcacacagctgatcaggggtttcggctcttcttggaaatcatcggtagagtcgctttcccaggacgtgatgcgttccttcactaactttcgcaacggtacctctattatccaaggggctcttactcagctaattcagctgtatcaccgtttccatagagttctctcgcagccacaactgagagccctccccgcacgggcagaactgatcaatatacatcacctgatggtggagctgaaaaaacacaaaccgaacttttag

SEQ ID NO: 55841 - DNA, 2106 bp, Artificial Sequence
  Description of Artificial Sequence: Synthetic coding sequence
atggaggaagaggaaggcccattagccggaggcccaggcttacaggagcccttgcagcttggcgagctggatattacatccgatgagtttatactagatgaggtggatgttcatatacaagctaatctggaggatgaactggtgaaggaggcccttaagacaggcgtggaccttagacattacagtaagcaagtcgaacttgaactgcaacagatcgagcagaaaagcattcgggactatattcaggaatcggaaaacatcgcctcgctccacaaccagattaccgcctgtgacgccgttttggagcgaatggagcagatgctgggtgctttccagtcagatctgtccagtatttcatccgaaatccggaccctacaggaacagtctggggctatgaatattcgcttgaggaatcgccaagcggtaaggggcaaacttggtgagctggtggatggactggtggtgccatccgcactggtaacagcaattctggaggctccagttaccgaacctcgcttcctggagcagctccaagaactcgatgccaaggctgctgcggtcagagagcaagaggctagggggaccgcagcctgtgctgatgtgagaggtgtgctcgacagactgcgcgttaaagccgtaacaaaaatcagggaattcattttacagaagatctacagctttagaaagccgatgaccaactaccagatcccacagaccgcactgctgaaatacaggtttttttatcagtttttactgggcaacgagcgggcaaccgcaaaggaaatccgggatgagtatgtcgaaaccctgagcaagatctacctttcgtattacagaagctatttaggacggctcatgaaagtgcagtatgaggaggtggccgagaaggacgatcttatgggggtggaagacacggcaaagaagggttttttttccaagcccagcctaaggtcaagaaacaccatttttaccctggggactcgaggcagtgtgatttctccaacggagctagaggctcccatcctggtcccgcacaccgctcagcggggagagcagcgttatccatttgaagctctgtttcgcagccagcactacgccttactggataattcctgccgagagtatctcttcatttgcgagttttttgtcgtgtctggcccagcagctcatgatttgtttcacgcagtaatgggcaggactctgagtatgaccctgaaacatttagattcttatctcgccgattgctatgacgctatcgctgttttcctgtgtattcatattgttctcaggtttaggaatattgccgctaaaagggatgtgcctgcacttgaccggtactgggaacaggtgctggcactgctttggcctcgctttgagctgatattggagatgaatgttcagtcggtaagaagcaccgatccgcagcgactaggaggcctggatacaagaccccactacattaccaggcgttatgccgagttctctagcgctctggtgtccatcaaccagacgatccctaatgaacggaccatgcagctcttgggccagctccaggttgaggtagagaatttcgtactgagggtggccgctgaatttagttcgcggaaggagcagttggtctttctcatcaataactatgacatgatgctcggcgtactgatggagagagccgctgatgactccaaagaggtggagtccttccagcaactcctcaacgcacgcacgcaggaatttatcgaagaattgctgtcaccacccttcgggggactagttgcattcgttaaggaggccgaagccctgatcgaaaggggacaggctgagcggctacggggtgaggaagctagggttacacagctcatacggggttttggcagttcttggaagtcctccgtcgagtcgttgtcacaggacgtaatgaggagcttcaccaatttccgcaacggcacatccatcatccaaggcgctttgacacagctgatccagctctatcatcggttccacagggtgctctctcagccacagttgagagctctgccggctcgggcagagttgataaacattcaccaccttatggtggagcttaaaaaacataaacccaacttctag

SEQ ID NO: 55842 - DNA, 2172 bp, Artificial Sequence
  Description of Artificial Sequence: Synthetic coding sequence
atggctgcggcagccaccatggccgctgctgcaagagaactggtgcttagggccggtacctccgacatggaagaggaggaaggacccctcgccggaggccctggactgcaggagcctcttcagcttggcgaactcgatatcacttccgacgaattcatcctggatgaagtcgatgtacatattcaagcgaacttagaagatgaactcgtgaaggaggctctcaaaactggcgtggacctcaggcactactctaaacaggttgagctcgagctgcagcagattgagcaaaaatctattcgcgactatattcaagagagtgaaaatattgcatccctgcacaaccaaatcacagcatgtgacgcagtactcgagcggatggagcagatgctgggggcattccagagcgatttgtcctcaatttcatctgaaatcagaacactgcaggagcaaagtggagcaatgaacatacgtctgcggaaccggcaggcagtccgaggaaagcttggagagttggtggacggcctggtggtgccaagtgcactggtgaccgccatacttgaagcaccagtgacggaacctcggtttctcgagcagcttcaggaacttgatgccaaagccgctgccgtgagggaacaggaggctagagggacagccgcatgcgcagacgtgaggggcgtgctagaccggctgagagttaaggccgtcactaaaattcgagagtttatcttgcaaaagatttacagttttagaaagcctatgaccaattaccagattccgcagaccgctcttctaaagtatcgcttcttctatcagtttttattggggaatgaaagagcaacagctaaagagatccgagacgagtacgtcgagactctaagcaaaatttacctatcctactaccgaagttatttaggcagactgatgaaagtgcagtatgaagaggtagcggagaaagacgatttgatgggcgttgaggacacagctaagaaggggttctttagtaagccttctctgcggagtagaaacaccattttcactttgggcacacggggatcagttatttcccccaccgagttagaagcaccaattctggtcccccacactgcccaacggggagagcagagatacccttttgaggccctgtttcgctcacaacactacgcgctgctggacaatagctgccgggagtacctttttatatgcgaatttttcgttgtgagtggaccagccgctcatgatctgttccacgccgtgatggggagaacattaagtatgacgttaaagcacctcgactcatacctcgccgattgctacgacgcaatcgccgtgtttctctgtatccatatcgtcctacgcttccggaacatcgcagctaaacgagacgtgcccgcactagacagatattgggaacaggttctcgccctgttgtggccacgcttcgagctaattctcgagatgaacgtccagagcgtgcggtctacggacccccagcgccttggtgggctcgatacccggccacattacataacccgccgatacgctgaatttagctcagccctcgtctctatcaatcagaccattccaaacgagcgtaccatgcagctgttagggcagctccaggtcgaagtggaaaacttcgtcctgcgcgtggcagccgagttcagttcccgtaaggaacagctcgtatttctgatcaataattacgacatgatgttaggcgtgcttatggagcgggctgccgatgatagcaaagaggtggagtcctttcagcagcttttgaatgctcgcactcaggaattcatcgaggagctgttgtcaccacctttcggaggcttagtcgcattcgttaaggaggctgaggccttaattgaaagaggccaagccgaacggctacgcggtgaagaggccagagtaacacagctgatcaggggctttggctcttcatggaaatcaagcgttgaatcactgtctcaggacgttatgcgcagcttcactaactttcgcaatgggacctcaatcatccagggggctctgacccagctcatccagctttaccacaggttccacagggtcttgtctcagcctcagctgagggccttacccgctagagcagagctgataaacattcatcatttgatggttgagctgaagaagcacaagccgaacttttag

SEQ ID NO: 55843 - DNA, 1797 bp, Artificial Sequence
  Description of Artificial Sequence: Synthetic coding sequence
atggagcaaatgctgggggcattccagagcgacctttcttctatcagcagcgaaatcagaaccctgcaggagcaatctggtgctatgaacatccgactccgtaaccggcaggcggtcagggggaaactcggcgagttagtagatggactagtcgtgccctctgccctggtgacggccatcctagaggcacccgttaccgaacctcggttcctagaacagctccaggaacttgatgcaaaggccgctgctgtgcgggaacaggaagcccgtggcaccgcggcatgcgccgacgtcagaggcgtgctggacagactacgcgtgaaggctgtgacgaagatcagagagttcattttgcaaaaaatctattcattcagaaagccaatgactaattaccagattccacagacagccttgctgaaataccgctttttttaccagtttctacttggcaatgagcgagccactgccaaggagattagggatgagtacgttgagaccctcagcaaaatatacctgagttactaccggagctatctcggaagactgatgaaggtgcagtatgaggaagttgcagaaaaagacgaccttatgggtgtagaggacactgcaaaaaagggctttttctccaagccttccctgcgctcacgaaataccatctttaccttaggcaccaggggcagtgtaatctccccaactgagctggaagcccctattttggtaccacatacagcccagaggggggaacagcggtatccctttgaggccttgtttcgttcccagcactatgctttattagataattcttgcagggagtatttgttcatctgcgagttcttcgtcgttagcggccctgccgcacacgacctctttcacgctgttatgggtaggactctaagcatgaccctcaagcacctggactcttacctcgccgattgctatgacgccattgccgtattcctctgcattcacatcgtgctccgattccgtaacattgcggctaagcgcgatgtgccagctctcgacaggtattgggaacaggtgctggctctcctgtggccacggttcgagctcatccttgaaatgaatgtccagtcagtgcgttctacggatccccaacgcctgggcggactggacactcgccctcattatataacgcgaagatatgccgagttcagctccgcgctggtgtcaatcaaccaaaccattcctaatgagcgcacgatgcaactgttagggcagttgcaagtggaagtggagaacttcgtgctccgggtggccgctgaattctcgagcagaaaggagcagctggtgtttctgattaataattacgatatgatgctcggcgtgctaatggagcgggctgcggatgattctaaggaggtcgagtcattccaacagctcctgaacgctagaacacaggagtttatcgaagagttactctcgccaccatttggaggcctggtggcgtttgtgaaagaagctgaagcgttgatcgaacgaggccaggccgagagattacggggtgaagaggctagggttacccagctgatcagagggttcggctcctcttggaagtccagtgtggaatccttgtctcaggatgtcatgcgaagttttaccaattttagaaatggtacctctattatccaaggggctctgacccagctgattcagctgtaccacagatttcatagggtattatcacagccgcagcttcgagcgctacctgccagggccgagttgatcaacattcatcacctcatggtggaacttaaaaaacacaaaccaaatttttag

SEQ ID NO: 55844 - DNA, 2172 bp, Artificial Sequence
  Description of Artificial Sequence: Synthetic coding sequence
atggcggcagccgcaaccatggccgcagccgctagggagctggtgctgcgcgcaggtacctcggacatggaggaggaagagggtccactcgcaggcggaccaggactgcaggagcccctgcaattgggagagctggacattacttctgatgagtttatactcgatgaggtggatgttcatatccaggccaacttggaggatgagctcgtgaaagaggctctgaagactggagtcgatctgagacactacagcaagcaggtggagctcgagctgcaacaaattgagcagaaatctataagagactacatccaggaatccgagaatatcgcaagcttgcacaaccagatcactgcctgtgatgctgtgctggagcggatggaacaaatgttaggcgctttccagtcagacttgtcatctatttcttctgaaattcgaaccctgcaggagcagtctggggcaatgaatattagactccgaaaccggcaagctgtgcggggaaagcttggggagctggtcgacgggttggtggtacctagcgccttggtgaccgctatccttgaggcaccggttaccgaacccaggtttctggagcagcttcaagagctggatgctaaggcagctgccgtaagagaacaagaagctcggggaactgccgcatgtgccgacgtgagaggcgtgctcgacagacttcgggtgaaggccgtaactaaaatccgcgagttcattcttcagaagatctacagttttcgtaaacccatgaccaactaccagatacctcagacagctcttctcaagtataggttcttttatcagttcctgctgggcaacgaacgggcaacagcaaaagaaatccgcgacgaatacgtagaaaccttgtctaaaatctatctgagctattaccgaagctatctggggaggctgatgaaagtccagtacgaagaggtagctgagaaggatgacttgatgggcgtggaggacacggctaagaagggtttcttcagtaaaccttcgttgcggagccgaaatacaatttttacgcttgggacgcgtgggagtgtcatatcgccaacagaactcgaagcccctatccttgtgccacacacagcacaaaggggagaacaaaggtatccatttgaggcactttttcgatcacagcactacgcccttcttgataattcatgtagggaatacctgtttatatgtgagttttttgttgtgagtggcccagcagctcatgacctgttccatgctgtgatgggaaggactctgagcatgacattaaagcacctcgactcttatcttgcggactgttacgatgcaatagccgtctttttgtgcatccacatagtgctgcggttccggaacatagctgctaagcgagacgtccctgctctggataggtattgggagcaggtgttggccctgctctggcccagatttgaactaattttggagatgaacgtccagagtgtgagaagcactgatccgcagagactcgggggtcttgataccaggcctcattatatcacacgcaggtacgcagagttcagtagcgccttggtcagtattaaccagaccattcccaacgagaggactatgcaactgctggggcagttgcaggtcgaagtagaaaattttgtgctgcgggtggctgcggaattctccagtaggaaggaacaattagtgttcctcatcaataattacgacatgatgctgggcgtgctgatggagagggccgctgacgactctaaagaagttgaaagcttccagcagctattgaacgctcgaacccaggagttcatcgaggaactcctgtctcccccttttggcggactggtggcattcgtcaaggaggcagaagctttgattgagcgtggccaggccgaaaggctgcgtggcgaggaggctcgcgtaactcagcttattcgtggatttgggagctcctggaagtcatctgtggaatcgctgtctcaggatgtgatgaggagcttcacaaattttcgtaacggaacgagtataatccagggtgcactaacacagctgatacagttgtaccaccggttccacagggttctctcacagcctcagttgagggctctgcccgcacgggcagagctcatcaacatccaccacctgatggttgaacttaagaaacacaaacccaatttttag

SEQ ID NO: 55845 - DNA, 2172 bp, Artificial Sequence
  Description of Artificial Sequence: Synthetic coding sequence
atggctgcggctgccactatggcagctgctgctcgggagcttgtgctgagagcaggtacttcggatatggaagaggaagagggccctcttgccggagggccaggactccaggagcccctgcagttgggcgaactggatattacatctgacgaattcatccttgatgaggtagacgttcacatccaggccaatctggaggatgaattggtaaaggaggctctgaaaactggtgtggatctgcgccactactccaagcaggttgagttagagctgcaacagatagagcagaaatcaatcagggattacatccaggagtctgagaatattgccagcctgcacaaccagatcactgcctgcgacgccgttttagaacggatggaacaaatgctgggcgcattccagtctgatctaagctcgatttcatctgaaatcaggactctgcaggagcagtccggggctatgaacattcgactgaggaatcgtcaggccgtgcgaggcaagctcggcgaattggtggacggattagtcgtgcccagtgctctggtgacggcgattctggaggctcccgttactgagcctagattcctggaacaactccaggagttggacgcaaaggccgctgcggtgcgggaacaggaagctaggggaactgcagcctgcgccgatgtgaggggggtccttgacagactgagagtcaaggccgtgaccaaaatccgggagtttattctccagaagatctattcctttcgtaaacccatgaccaattatcagatcccgcagacagccctgcttaagtatcgtttcttctaccagttcctcctcggaaacgagagagcaaccgccaaggaaattcgagacgagtacgtggaaactctttccaagatctatctctcatactacagatcctacttaggacggctcatgaaggtgcagtacgaagaagtagccgaaaaggacgatttgatgggagtggaagatactgccaagaaagggttctttagtaaaccatctcttcggtccagaaatactatctttactctgggtacgcggggatctgtgatttcacccacggaactggaggccccaatcctggtgcctcacaccgcccagaggggcgaacaaaggtatccgtttgaagctcttttccgttcccagcattacgccctgctggacaatagttgtcgtgaatatctcttcatttgtgaattcttcgtggtgtcaggacccgctgcccatgatctctttcatgccgtgatgggcagaaccttgagcatgacacttaaacacctggactcctacctcgccgattgctacgatgctatagcagtttttctctgcatccacattgtgctccgctttcgaaacatcgccgctaagagggacgtccctgctctcgaccgatattgggagcaggtgctggcactcctgtggccaaggttcgagctcattttggagatgaacgtccagtcagtgcggtctaccgacccgcagcgtctgggcggactcgatactcgaccacattatattacaaggaggtatgccgaattctcctctgcgcttgtcagtattaatcagactattccaaatgagcgcacaatgcagctgctaggccagctgcaggtcgaagtcgagaattttgtgttgagggtggccgcagaattttcctcacggaaggaacagcttgttttcttaattaacaattacgacatgatgctgggtgtacttatggagagggctgcagatgactctaaggaagttgagtcattccagcaacttctcaatgcacgcacccaggagttcatcgaagagctgctgagtccgccatttgggggtctggtggccttcgtgaaagaagcagaggcccttattgagagggggcaggccgagcggctgcggggagaggaggccagagttacccagctgataaggggtttcggctcgagctggaagagctctgtggaatctctcagtcaagatgttatgcgaagtttcaccaacttcaggaacggtacttcaattatacaaggtgctctcacccagttgatacagctctaccacagattccatcgggtgttaagtcagcctcaactgcgcgcactaccagccagggcagaactgatcaatatacatcacttgatggtggaactgaaaaaacataagcccaatttttag

SEQ ID NO: 55846 - DNA, 2172 bp, Artificial Sequence
  Description of Artificial Sequence: Synthetic coding sequence
atggctgcagcggcaacaatggctgctgctgccagagaacttgtcctcagagctggaacatctgatatggaagaagaagaaggacctctggcaggcggaccgggactgcaggagccattacaactgggtgagctagacattacctctgacgagtttatactcgacgaagtcgatgtccatatccaagccaacctggaagatgagctcgtgaaagaggctcttaaaactggcgtggacctgcggcactattcgaagcaagtcgagcttgagcttcagcagatcgagcagaagtccattagggactatatacaagagtcggagaacatcgcctctctccataatcaaattactgcctgcgacgccgtccttgagaggatggaacaaatgctgggggcattccagtctgacctcagcagtattagcagcgaaatcaggactctccaggagcagagcggtgccatgaacatccgcctccgaaacagacaagccgtgcggggaaagttgggtgagctggtcgatgggctcgtagtgccctctgctttagtgacggcaatactggaggctcctgtcaccgagccacggttcttggagcaactgcaggaactcgacgcaaaggccgctgcagtgcgcgagcaagaggctaggggaaccgcggcttgcgccgacgtaagaggggtgctggaccgtctgcgcgtaaaagcagtgactaaaattcgtgaattcatactgcagaaaatctacagtttccgtaaacctatgacaaactaccagattcctcaaacagccctcctgaaatatcgttttttctatcagtttcttctgggcaacgaaagagcaactgccaaggaaataagggatgagtacgtggagaccttgtccaagatctacctgtcatactataggtcttacctggggcgactgatgaaagtgcagtacgaggaggtggccgagaaagatgacctgatgggggtggaggacactgctaagaaaggattctttagcaaaccatcgctgcgcagccgcaacacaatctttacgctgggtacccgcggaagcgtgatcagccctaccgaactggaggcaccaattttagttcctcacacggcacaacggggtgagcagcgctatccgtttgaggccctgtttaggtcccaacactatgcgttgctggacaattcctgcagagaatatttgttcatatgcgagttcttcgtagtcagcggacctgccgcacacgatctctttcatgctgttatgggcagaacactttcaatgactctcaagcacttggacagttaccttgccgactgctacgacgccattgcagttttcctctgtatccatatcgttttgcgatttcgtaacatcgccgcaaaacgtgacgtgccagcactggatcgctattgggagcaggtgctggcactgttgtggcctcgttttgagttgattctggagatgaacgtacagtctgtccgtagtaccgaccctcaaagattggggggactcgacacccgacctcactacataactcggcgatatgccgaattttccagcgcattggtgagcatcaatcagaccattccaaatgagcgcactatgcagctcctggggcagcttcaagttgaggttgagaattttgttctgcgcgtggccgctgagttctcgtccagaaaagagcaactcgtcttcctgattaacaattacgatatgatgctcggcgtcctgatggagcgcgcagccgatgattccaaagaggtggagtcctttcagcagcttctcaatgccagaacccaagagtttatcgaggaactgcttagtccgccttttgggggacttgttgcgttcgtcaaagaagcagaggctctcattgaaagaggccaggccgagaggctgcgaggcgaggaggctcgggtcacgcaactcatcaggggcttcgggtcttcttggaaaagctcagtagagtcgttgagtcaggatgtgatgagatcgttcaccaacttccgcaatggcactagtataatacagggggcattgactcagctcatccagctataccataggtttcatagagtgctgagccagcctcagttgcgcgcacttcccgcacgagctgagctcattaacattcaccacctgatggtggaactgaagaaacacaagccaaacttttag

SEQ ID NO: 55847 - DNA, 2172 bp, Artificial Sequence
  Description of Artificial Sequence: Synthetic coding sequence
atggcagcagccgctaccatggccgctgctgccagggaactcgttcttagagcaggcacctctgacatggaggaagaggaggggccacttgctggagggcctggcttacaagaacctctccagctcggagagctggacatcacctcagacgagtttatcctggacgaggtggacgttcacattcaagctaatctggaggacgaactagtgaaggaggctctcaaaactggcgtggacctgcgtcactattcaaagcaggtggaactggaactccagcagatcgagcaaaaatcgatccgcgactacatccaggagagcgagaatatcgcctccctacacaaccagatcactgcgtgtgacgcagtcctggaaaggatggagcagatgctgggagccttccagtcagatctgtcctccatatcatcagaaattaggaccctccaggagcaatccggagcaatgaacatcaggctgcggaaccgtcaagcggttagggggaagctgggggagttggtggatggactcgttgttccatctgctctggtgacagctattctcgaggcccctgtgacagaaccacgttttctggagcagttacaggagctagacgccaaagccgctgccgtaagggagcaagaggcacgaggcactgcagcctgcgcagatgtgaggggagtccttgaccgactgcgtgtgaaggccgttactaagattcgggaatttatattacaaaaaatttattccttccgaaagcctatgactaactatcagatcccacagacagctctgcttaagtacagattcttttaccagttccttcttggtaacgagcgtgccaccgccaaggaaatccgggatgaatacgtcgagacgctgagtaagatatacttaagctattataggagttatctcggcaggctaatgaaagtgcagtatgaggaagtggccgaaaaagatgacctcatgggggtggaggacacagctaaaaaaggattcttttccaaaccctccctgcggagtaggaataccatctttacacttgggacacgtggttccgtcattagcccaaccgagctggaagcgccaattcttgtcccccacaccgcgcagagaggcgaacaacggtacccattcgaagccctcttcaggagccagcactatgctcttctagacaatagctgcagggaatatctctttatctgtgaattctttgtagtgtccggcccagcagctcacgacctcttccatgcagtgatgggacggacactcagcatgactctgaagcaccttgacagctatctggcagattgctacgacgcgatcgccgtctttttatgtattcatatagtgcttcgctttcgaaacatagccgctaagagggatgtgcccgcactcgatcggtactgggaacaggttctggctctcctgtggccaaggtttgaattgatcctggagatgaacgtgcagagtgttcggtccactgaccctcagcgactcggtggcctggacaccagaccacactatataaccaggcgttatgcagagttttcatctgccctagtttctatcaatcagacaatccctaatgaaaggactatgcagctgcttggtcagctccaggtcgaggtggagaactttgttctgcgggtggccgctgagttttcgtcaaggaaggaacaactggtgtttttaatcaacaactacgacatgatgctaggtgtcctgatggagcgtgcagccgacgactcaaaagaagtggagagttttcagcagctgctcaacgccagaacacaggaattcatcgaggaattactgagtcctcctttcggaggcctggttgccttcgtaaaagaagccgaggcactcattgaaagaggccaagcagaaaggcttagaggcgaggaagccagggtgacccagttaatccgtggatttggctcaagctggaaaagctccgtggaatcgctgagccaggacgtcatgcgatcctttaccaatttccgaaacgggacctctatcatccagggggcactgactcagttgatccaactgtaccaccgcttccatcgcgtgctgtcacagccccaactgcgagctttacctgcacgagccgagctgatcaatattcatcatctgatggtggagctgaagaagcacaaaccgaatttctag

SEQ ID NO: 55848 - DNA, 2106 bp, Artificial Sequence
  Description of Artificial Sequence: Synthetic coding sequence
atggaggaagaggaaggacccttggcaggaggaccagggctgcaggaaccgttgcaacttggcgagttagatattacttctgacgagttcattttagatgaggtggatgtccatattcaggccaatctggaagatgaacttgttaaagaggccctgaagaccggcgtcgacctccgccactactctaagcaggtggaactcgaactgcagcaaattgagcagaagtccatccgggattacatccaggaatccgaaaacatcgccagccttcataaccaaattaccgcttgcgatgctgtgctcgagcgtatggagcagatgctcggtgcatttcagagtgatctaagctctatttcttcggaaatcaggactctgcaggagcagtcaggcgcaatgaacattcggctccgcaatcgtcaggctgtgcgtgggaaactgggagagttggtggacggcctggtcgtgccatccgctctggtgactgcgatcttggaagcccctgtgacggagcccaggtttctggaacagctgcaggagttagatgccaaggccgctgcagtgagggaacaggaggcacgaggaaccgccgcttgcgcagatgtgcgcggtgtccttgaccgactgagggtcaaggccgttacaaaaatcagagagttcattctacagaagatctacagttttcgaaaacccatgacaaattaccaaattcctcagaccgcgctcttgaaatatcgattcttctaccaattcttacttggaaatgagcgggctactgctaaagagatcagggatgagtacgtcgaaactctgtccaaaatctatctgtcctattaccgtagctacctgggccgactcatgaaagtgcagtatgaagaagtggcggaaaaggatgatctgatgggagtggaggacaccgccaagaagggattctttagtaagcccagtcttcgtagccgcaataccatctttaccctggggaccaggggttctgtcatcagcccaaccgagctggaagcgcctattcttgttccacacactgcacagaggggggagcagcgatacccctttgaggccctgttccggtcccagcactacgctctgctcgataactcgtgcagagaatatctgtttatctgcgaattttttgtagtgtccggaccagccgctcacgatctgttccacgctgtgatgggacgaaccctgagcatgacccttaaacacctggacagttatcttgcagactgctatgacgctatagccgtgttcctctgtatacacatcgtgttgcgattcagaaacattgcagcgaaacgagatgtgcccgctctcgatagatactgggaacaggtgcttgcgctgctctggcctcgctttgaactaatcttggagatgaacgtgcagtccgtgagatcaaccgacccccagcggctggggggactcgacacgcgccctcactatataacaaggcgctacgccgagtttagctccgcactcgtgtccatcaatcagactatccccaacgaacggacaatgcaactattaggacagctgcaggtcgaggttgaaaatttcgtcctccgcgtggctgccgagttttcttccaggaaggaacagctagtgttcctgatcaataattacgatatgatgctgggcgtacttatggagcgggcagccgacgactccaaagaggtagagtcttttcagcaactccttaatgcacggacccaggaattcatcgaggagcttctgagtcccccatttggtggactggtcgcctttgtgaaggaagctgaagcgcttattgagcggggtcaggcggaacgactgaggggggaagaggctagggtcactcagctgattaggggtttcggttcatcatggaagagctccgtcgagagcctctcgcaggacgtgatgaggtctttcacaaatttccggaacggcactagcatcatccagggcgctcttacacagctcatccagctgtaccaccgctttcatcgggtcttgtcacagccccagttgagagctctgcctgctcgggcagaacttattaatatccatcacttgatggttgagctaaagaagcacaaaccaaatttctag

SEQ ID NO: 55849 - DNA, 2106 bp, Artificial Sequence
  Description of Artificial Sequence: Synthetic coding sequence
atggaggaagaagagggaccattggctgggggacctggcctgcaggaacccctgcagcttggtgagctcgatataacttctgacgagtttatccttgacgaggttgatgttcatattcaggccaatctagaggacgaactagtcaaggaagccctgaagacaggcgtggacctgagacactacagcaagcaggtggagctcgaactgcagcaaatcgaacagaagagcatccgtgactatatccaggagtccgaaaacatcgcttcactgcataaccagatcacggcatgtgatgctgtcttagagagaatggagcagatgttgggggcttttcagagcgatcttagctcgatcagttccgagattcggaccctccaagaacaaagcggggctatgaacattcggctgagaaatcgtcaggccgtgcgcggaaaactgggagagctcgtcgatggcttggtcgttcctagtgccctggttacggccatccttgaagcacccgtcaccgaacccagatttctggagcagctccaggaattggacgctaaggccgcagcagtccgtgagcaagaagcgcgaggcactgcagcctgtgcagacgttaggggggtcctcgacagactccgggtgaaagctgtcacaaagatcagagagtttatcctccaaaagatctactcctttagaaagcccatgacaaactaccagattccccagacagccttgttgaaatatagatttttctaccaatttctgttgggaaatgaacgggcaacagctaaggagattcgggacgaatatgtcgaaactttgagcaaaatctacctgagttattaccggtcatacctgggacgcctgatgaaggttcagtacgaagaggtcgctgagaaggatgacctcatgggcgtggaggataccgccaaaaaaggattctttagcaagccctcattaagatcgcgcaacacaatctttacactgggtactcgaggaagcgtcatcagccccactgagctggaggcccctatcctggtgccgcacaccgcacagagaggagagcagcggtacccgtttgaggcactgtttcgatcccaacactacgcccttctggataattcctgtcgcgaatatctatttatatgcgagtttttcgtggtatctggacctgcggctcacgacctgttccacgcagtgatgggacgcaccctttcaatgactctaaaacacctagacagctaccttgctgactgctacgacgccattgctgttttcctctgcattcacatcgtgctgaggttccggaatatcgcagctaagagggacgttcccgcactggatcggtattgggagcaagtcctcgccctgctttggcccagattcgaactgatattggaaatgaacgttcagtctgtgagatccaccgatcctcagaggttgggtggactggacacacgccctcattacatcacgagaagatatgccgagttttcctccgccttggtctcgatcaatcagacaatccccaacgagagaacgatgcagttactgggacagctgcaggtggaagtggaaaacttcgtgcttcgggtcgctgctgagttttcctcacggaaggagcagctggttttcctcattaacaattatgatatgatgttgggcgtgctgatggaaagggccgctgatgatagcaaggaggtggagagctttcagcagctcctcaacgccagaacccaggaatttatcgaggagctcctgtcacccccttttggaggacttgtagccttcgtgaaggaagcggaggcactgatagagcgcggtcaagccgaacgcctccggggtgaggaagcaagagtcacccagctgatcagagggtttggatctagttggaagtcatccgtggagtctttatcccaggatgtcatgagaagctttaccaattttcggaatgggaccagtattatccaaggggctctgacacaactgatccagctttaccaccgatttcaccgggttctttcccagccgcagctccgtgctttacctgctcgggctgagttgatcaacatacatcacctcatggtggagctaaagaaacataagccgaatttctag

SEQ ID NO: 55850 - DNA, 1797 bp, Artificial Sequence
  Description of Artificial Sequence: Synthetic coding sequence
atggagcagatgctgggagctttccagagtgatctttctagcatcagctcagagatcagaacccttcaagaacagagcggagccatgaacataagactcaggaatcgtcaggccgtgcgagggaagctcggcgagctggtggacggactagtggtgcccagcgctctcgttaccgcaattcttgaagctcccgttactgagccaaggtttctggagcaactgcaagaactggatgctaaggctgcagccgtgagggagcaggaagcacgcggaacggccgcttgtgccgacgtgaggggcgtgctcgatcggctgcgggtgaaggctgtcacaaagatccgtgagtttatcctgcagaaaatctatagctttaggaagccgatgaccaattatcagatccctcaaactgccctcctgaagtacagattcttttaccaatttttactggggaatgaaagagctacagcaaaggagatcagagacgagtatgtggagacactctccaaaatctatttgagttattatagatcttatctcggacgactgatgaaggtgcagtacgaggaggtggcggagaaggacgaccttatgggcgtagaggacaccgctaaaaaggggttcttttcgaagccttcccttagatcacgtaatacaatcttcacactcgggactcgcggttccgttatctctccaaccgaacttgaagctcccatattggtgccccacacggcgcagcggggtgagcagcgctaccctttcgaggccttgtttcgcagccaacattacgctttgctcgacaacagctgtagagagtaccttttcatctgtgagttcttcgtagtgagcgggcctgcagcccatgatctgtttcatgctgtcatgggcaggaccctgagcatgactttgaagcacctggacagttacctggcggattgctacgacgcgatagctgtgttcctttgcatccacattgttttgcgatttaggaacatcgcagcaaaaagggacgtacccgctctagatcgctactgggagcaggtcctggcactgctgtggccgagattcgaactgatccttgagatgaacgtacagagcgtgcgcagcaccgatcctcaaaggctgggaggccttgacaccagaccacactatatcacacgtagatacgccgaattttcttccgccttggtttctatcaaccagaccattcccaacgaaagaacaatgcagttgctgggtcagctgcaggttgaagttgaaaactttgtgttaagggtcgccgcagagttctcttctcgcaaggagcagttagtcttccttattaataattacgatatgatgttgggggtcctgatggagagggctgctgatgattctaaggaggttgaaagcttccaacaacttcttaacgctcgcacccaggaattcattgaggaactgctgagcccgccatttggtggtctcgtggctttcgtgaaagaggctgaagcgttgattgaaagggggcaagcggagagattgcggggtgaggaggcaagggtgactcaactgatcagagggttcggaagtagctggaagtctagtgtagaatcccttagtcaggacgtgatgagatccttcaccaacttcaggaacgggacgtcaatcattcaaggagcactcacccagcttattcagctttaccatcgcttccaccgagtgctctcccaaccccagcttagagcactgccagcacgtgctgagctcataaatatacaccacttgatggtggaactcaagaagcacaaacctaatttctag

SEQ ID NO: 55851 - DNA, 1797 bp, Artificial Sequence
  Description of Artificial Sequence: Synthetic coding sequence
atggaacagatgctgggggctttccaatccgacctgtctagtatctcaagcgaaatcagaactctccaggagcagagtggagcaatgaacattagactccgtaatcggcaggccgtcagagggaagctgggtgaattggtagatggcctcgtggtgcctagcgctctagtgactgcgatcttggaggcccctgtgacagaacctaggttcctagagcagctgcaggagctggatgcaaaggccgctgctgtacgagagcaggaggccaggggcactgcagcatgcgccgatgtcagaggcgtgctggataggcttcgggtgaaagccgtgacaaagatcagggagtttattcttcagaagatttatagcttcagaaaacctatgaccaactaccagatcccgcagaccgccctgctcaagtaccggttcttttatcagtttttactgggcaacgaaagagccacagccaaagagatccgtgacgagtatgtagaaaccctgtctaaaatctacttgtcatattaccgttcctacttgggcagactcatgaaggtgcaatacgaggaggtagccgagaaagacgatcttatgggagtcgaagacacggccaagaaagggtttttctcgaaaccgtccctcaggtcacgtaacacaatctttaccttgggcactagaggctctgtgattagccccacagaactggaagccccaattcttgtgccacatacagcccagcgcggagagcagagataccccttcgaagcattgtttcgtagccagcactatgccctgctggataactcatgtagggagtatctcttcatttgcgagtttttcgttgtcagtggtcctgccgcacacgacctcttccacgcagtgatggggagaaccctgtcaatgacgcttaagcatctggatagttatctggccgactgttacgacgctatagctgttttcctttgcattcatattgtgcttcgattcaggaatatcgccgctaaaagagatgttccggctctggaccggtattgggagcaggtgcttgcacttctctggccaaggtttgagttaattctcgaaatgaacgttcagtcagttagatctactgatcctcagcggctgggtgggctcgatactcgacctcactatataacacggagatacgctgagttctcatcagctcttgtatctatcaaccagactattcctaatgaaagaaccatgcagctgctgggacagctgcaagtggaggtcgaaaattttgtcctgagagtagccgcagaattctcgtctcgcaaagagcaactcgtgtttctcatcaataactacgatatgatgctgggcgttctgatggaaagggcggctgatgactccaaggaagtcgaaagctttcagcagcttcttaacgcgcgaacccaggaatttatcgaggagctgctgtccccgccttttgggggactagtggcctttgtgaaggaagccgaggcccttatcgaaagagggcaagcggaaaggctgcgcggagaagaagcaagagtcacacagcttatcaggggatttggctcctcctggaaatcatccgtggagagtctcagccaggacgtgatgaggtccttcacgaattttagaaatggtacatccataatccagggagccctcacgcaattgatacagctttaccaccggttccacagagtgctgtctcagccgcagctgcgcgcactccccgctcgagcagagttaattaatatccatcacctgatggttgagcttaagaaacataagccgaacttctag

SEQ ID NO: 55852 - DNA, 1443 bp, Artificial Sequence
  Description of Artificial Sequence: Synthetic coding sequence
atgtctgacgtggccattgttaaggaaggctggctccataagcggggagaatacatcaagacatggcgacctcgatactttctgctgaaaaacgacggtaccttcattgggtataaggagaggccccaagatgttgaccagcgggaggctcctttgaacaacttctcagtggcgcagtgccaattgatgaagaccgaaagaccaaggcccaacacatttatcattcgctgcctccaatggactacagttattgagcgtacctttcacgttgagactcccgaggaaagagaggaatggaccaccgctattcagactgtcgcggacggcctgaaaaagcaggaggaggaagaaatggacttccggtccggaagcccctccgataacagcggcgctgaggaaatggaggtgtccctcgcaaagcccaagcaccgtgtgactatgaacgagtttgaatatctgaaattactcggtaagggcacttttggtaaggtcattctggtcaaggaaaaggctacgggaaggtattacgccatgaaaatcttaaaaaaggaagtaattgtggcaaaagacgaggtggcccacaccctgactgagaatcgtgtgctccaaaatagtaggcacccctttcttacagcattgaagtattcttttcagacacacgatcggctgtgtttcgtgatggagtacgcaaacggcggtgagctcttttttcacctgagtcgcgaacgggtcttcagtgaggatagggcccgattctatggggctgaaatcgtcagcgccctcgactacctgcactctgagaaaaatgtcgtgtacagggacttaaaactggagaatctcatgctcgataaagatggccatatcaagatcaccgactttggtctgtgcaaggaagggataaaagatggagcgacaatgaagacattttgcggcactccagaatatctcgccccagaggtgctggaggacaacgattatggtcgagctgtcgactggtggggtctaggcgtggtaatgtatgagatgatgtgcgggaggctgcctttttacaatcaggatcatgagaaactttttgaactgatactcatggaagagatccgctttccacgcactttagggcctgaggccaagagcttattatcaggactgttaaagaaggacccgaaacagcggctgggaggaggatccgaggacgcaaaagagatcatgcagcaccgcttcttcgccggtattgtgtggcagcatgtttatgaaaagaagttgtcaccccctttcaaaccacaggtgacttccgaaaccgacacaaggtactttgacgaagagtttacggcccagatgataaccatcaccccccctgaccaggacgacagtatggagtgcgtggactccgagcgacgcccacactttcctcaattctcttatagcgccagcgggacggcctag

SEQ ID NO: 55853 - DNA, 3192 bp, Artificial Sequence
  Description of Artificial Sequence: Synthetic coding sequence
atgccacacctgcccctcgcctcttttcgtcccccattctggggcctgagacactctcgcggactgccccgttttcatagcgtgtctacgcagtcagagccccatgggtcacccattagccgaagaaacagagaagccaagcagaagagactgagggaaaaacaagccacactggaggcagaaattgctggggaaagtaagagcccggcagagtctatcaaggcttggagaccgaaagagctcgtcttgtatgagatccccaccaagcctggcgagaaaaaggatgtatcaggtccgctcccgccagcatactctcctaggtatgtcgaggccgcttggtacccctggtgggtaagagaaggtttttttaaacctgagtaccaagctagactgccccaagcaaccggagaaaccttctctatgtgcatccccccacccaacgttaccggctccctgcatatcggtcacgccttaaccgtggctattcaggatgcgctggtccgttggcaccgaatgcggggagatcaggtcctctgggtgccgggaagcgaccacgccggtatcgctacccaggcagtggtcgagaaacagctgtggaaggagcgtggagtgcggagacacgagctgtctcgggaggccttcctaagagaagtgtggcagtggaaggaagcaaagggtggggaaatctgtgagcagctgcgcgctctgggtgccagcctggactgggatcgtgagtgctttaccatggacgtgggaagttctgtcgctgtgaccgaagcatttgtgagactgtacaaggccggacttctgtaccggaaccaccagctggttaactggtcttgcgccctgcgctcggctatctccgatatcgaagtcgaaaatcgacctctacccggtcacacccagctgcgattacctgggtgccccaccccagtgtctttcggcctcctgttcagtgtggcatttcccgttgacggggagcctgacgccgaagtggtcgtcggaaccacacggccagaaaccctacccggagatgtagccgtagcagtgcacccagatgactcaagatacacccacctccacggtaggcagctaagacatccactgatgggtcaaccactgcctcttatcacagactatgcggtccaaccccatgtaggcactggggctgtaaaggtcactcctgctcactcacctgccgacgcagaaatgggcgctcgtcatggcctgtctcctttgaacgtgattgccgaagatggtaccatgacatcactgtgtggcgactggttacagggactgcatcgatttgtagccagagagaagatcatgtctgttctgtctgaatggggacttttcagaggtttacagaatcacccaatggtgctgccaatttgtagccgatccggtgatgtgatcgagtacctgctgaagaatcagtggttcgtgaggtgccaagagatgggagcaagagccgcaaaagccgtggaatctggagccctggaactctctcccagcttccaccagaagaattggcagcattggttcagccatatcggtgattggtgcgtttcacggcagttgtggtggggacatcagatcccagcctatctggtcgttgaagaccacgcacagggcgaggaggattgttgggtcgtgggccgatctgaggccgaagcaagagaagtggccgctgagctgactggcagacccggtgctgaactgactctcgaacgcgaccccgatgtattggatacttggttttcgtcagcactcttcccttttagcgctcttgggtggccccaggagacccccgatttagcgaggttctaccctctctccctgctggaaaccggatcagatctgctcctgttttgggtgggacgaatggtgatgcttgggacccaattaactggacagctgccattctctaaggtgctcctgcatccaatggtgagggaccgacagggacggaaaatgagcaaatcacttggaaacgtgctcgatcctagggacatcatatcaggggtcgagatgcaggtgttgcaggagaagcttcggtccggcaatttggaccccgctgaattagccattgtggccgctgcccaaaaaaaggacttcccgcacggaattcctgaatgcggaactgatgcactgaggttcaccctctgttcgcatggcgtgcaggccggtgatctccacctctcagtttcagaggtgcagtcctgtcgtcatttctgcaataagatttggaacgcgcttcgcttcatcctgaacgccctgggcgagaaatttgttcctcagcctgcagaggagctttcccccagctcccccatggacgcatggatcctgagtcgtcttgctctcgccgctcaagagtgcgagagaggcttcttgacacgcgaactgagtttggtaacacatgctctgcatcacttctggctgcacaatttgtgcgacgtgtacttggaggcagtgaagcctgttctctggcatagtcccaggcctctggggcctcctcaggtgctgttttcatgcgccgacctgggactgcggctgcttgctccgttaatgccatttctggcggaagagctctggcaacggctgccccctcgcccaggctgccctcccgctcccagcatatcagtagcaccttatccttcagcttgcagtctcgagcattggcgtcaacccgaacttgaacgcaggtttagccgcgtgcaggaggttgtacaggtgcttagggccctgcgcgcaacttaccaattaacaaaagctaggccccgagtgctgttgcaaagttcggaacccggagaccagggccttttcgaggcattcctcgagccactgggcactctcggctactgtggagccgttgggttgctaccaccaggtgctgcagccccatcagggtgggctcaagcccctctgtccgatacagcccaggtgtatatggagctccaagggcttgtcgacccacagattcagcttccattactcgccgctcgcaggtacaaactgcagaagcagctggacagtttaactgctcgaacaccaagcgaaggtgaggccggaacacagcgacagcagaagctgtcctcactgcagctagagctcagtaaactggataaagccgcatcccacctgcagcaactcatggatgaaccacctgccccaggatccccggaattgtag

SEQ ID NO: 55854 - DNA, 348 bp, Artificial Sequence
  Description of Artificial Sequence: Synthetic coding sequence
atgccccacctccctctggcatcattcagaccacccttttggggcttacgccatagcagggggctgccccgtttccatagcgtcagcacacagtccgaaccacacggttcacccatcagtaggcggaatcgtgaagccaagcagaaacgcctgagggagaagcaagcaacactcgaagccgaaatcgcaggggaatccaagtctccagccgaaagtattaaggcctggcgaccaaaagaattggtcctttatgagattcccactaagcccggtgagaaaaaagacgtttcaggcccactgccccctgcttattccccaaggtatgttgaagcggcttggtacccatag

SEQ ID NO: 55855 - DNA, 981 bp, Artificial Sequence
  Description of Artificial Sequence: Synthetic coding sequence
atgccacacctgccccttgcctcttttaggcctcccttttggggactgcggcatagcaggggattgcctagattccacagcgtatctacccagtctgaaccacacggctctccaattagccgaagaaaccgggaagctaagcagaaacgactgcgcgaaaagcaagccacccttgaggcagaaattgctggtgagagtaagtcaccagccgaaagtattaaagcatggcgccctaaggaattagtgctgtatgaaatccccaccaaacccggagagaaaaaggatgtgtcggggccactacccccagcctactccccccgttacgtagaggccgcttggtacccctggtgggtgcgggagggcttcttcaaacccgagtaccaagccaggctgccacaggctacaggcgaaacattcagcatgtgtataccgcctcctaacgtgacaggctcgctgcacataggacacgccttgacagttgccattcaggacgcactggtgcgttggcacagaatgcggggagaccaggtgctatgggtgcctggctccgatcatgccggaatcgctacccaggcggtcgtggagaaacaactctggaaggaacgcggagtgaggcgtcacgagttgtcccgggaagccttcttgagagaagtctggcagtggaaagaggccaaaggcggtgaaatatgcgaacagttacgtgccttgggcgcttctctcgattgggaccgtgagtgtttcaccatggacgtgggttccagtgtggccgtcaccgaggcgtttgtgagattgtataaagcaggattgctctatcggaaccaccagctggttaattggtcctgcgccctgagatccgctatatctgacatagaagtcgagaaccggccactccccggacatacccagctgcgtctaccaggttgtcccacccctgttagtttcggcctcctgttttctgtagcctttccagtggatgggtag

SEQ ID NO: 55856 - DNA, 774 bp, Artificial Sequence
  Description of Artificial Sequence: Synthetic coding sequence
atgcctcatctgcctctggcttcttttagaccccctttctgggggcttcgacactccaggggtctccctcggtttcactctgtgagtacacagagcgaaccgcatggttccccaatcagtcgtaggaatagggaggccaagcaaaaacgtcttcgggaaaaacaggccaccctcgaagctgagatcgccggagagtctaagtcccccgctgaaagtatcaaggcatggagacccaaagagctggtcctttatgaaatccccacaaaacctggcgaaaaaaaggatgtatcagggcctctccccccagcctattccccaagatacgtagaggccgcttggtacccttggtgggtgcgcgaaggattcttcaagccagagtatcaggctcgtctgcctcaggctactggcgagaccttctcaatgtgcatcccaccgcctaatgtcacggggtcgctccacattggtcacgcactaaccgtggccatccaagacgcgcttgtaagatggcatcgtatgagaggcgaccaggttctgtgggtccccggtagtgaccacgctggaatcgcaacacaggccgttgtagaaaagcagctgtggaaggagcggggtgtgaggaggcacgagctgagcagggaggcattcctgcgcgaagtgtggcagtggaaggaagctaaaggcggtgaaatatgcgaacagctgagggccctgggtgcttcacttgattgggacagagtgttctaccacgggtgctggctactgtccggatgcgattag

SEQ ID NO: 55857 - DNA, 2772 bp, Artificial Sequence
  Description of Artificial Sequence: Synthetic coding sequence
atgtgcatcccccctcctaacgtaaccggatcactgcacatcggacacgctctaacggtcgcaatccaggatgctttagtgcgatggcatcggatgcgcggagatcaggtgctgtgggtgcctggctctgaccacgctggaatcgctacccaagccgtagtcgagaaacagctatggaaggaacgcggtgtgaggcgtcacgagctaagcagagaggcattcttgagagaggtgtggcaatggaaagaggccaaaggcggtgagatctgtgaacagcttagagccctcggagcgtccctagattgggaccgtgaatgttttacaatggacgtagggtcgtcagtagctgtcactgaggcttttgtcagactgtataaggcagggctactgtaccgaaatcatcaactggtgaattggtcttgtgccctgagaagcgcgatttcggatatcgaggtcgagaaccggccactgcccggacatacacaattgcgcctgccaggctgtccaacccctgtgtcctttggactgctgttttccgtggcgttccccgttgatggggaacccgacgcagaggtggtcgtcggcaccacccgtcctgagacactcccaggtgatgttgctgtagctgtgcaccccgatgacagtcggtacactcacctgcacgggaggcagctacgacatcccttgatgggtcagccactgcctctcattaccgactatgccgtgcaacctcacgtaggaaccggagccgtgaaagtgactccggcacactcacccgctgatgctgaaatgggggctagacacggcctttcaccactcaatgtaatcgccgaggatgggactatgacatcactttgcggagattggctccagggcttgcatcggttcgttgccagggagaagatcatgagcgtcctgtctgagtggggcttatttcgcggtctccagaaccatcccatggtactgccaatctgcagtagaagcggggacgtgattgaatacctgctgaaaaaccagtggtttgtgcggtgtcaggaaatgggagccagagcggcaaaggcagtcgaatctggggcactggagctgagtcccagcttccaccagaaaaactggcagcactggttctcacatattggggactggtgcgtgtcacggcagttatggtggggacaccaaattccagcatacctagtggttgaagaccacgcccagggagaagaagattgttgggttgtcggcagatccgaggccgaggcgagagaagttgccgcagaactcaccggcagaccgggtgccgaacttaccctggaacgcgatcctgacgttttagatacgtggttttctagcgcattattccctttcagcgcactgggttggcctcaagaaacgccggatctggctcggttctatcctctgtcactgctggagacgggcagcgatttgttgttgttctgggtggggaggatggtcatgttgggcacccagctaacaggccagcttccctttagcaaggtgctcttgcatcccatggtgcgggatagacagggacggaagatgtccaagtctctgggcaatgttcttgacccccgagacatcatatcaggagtggagatgcaggttctccaggaaaaactcagatcgggcaacctcgacccagccgagcttgctattgtagcagctgcccagaaaaaggactttcctcacggaatccctgagtgtggcactgatgccctccggttcacactgtgttcccacggggtccaggctggggatttacacctctcggtgtcagaggtgcagtcctgcagacatttctgtaataaaatttggaacgcactgaggtttatcctcaacgcactgggcgaaaagtttgttccacagcccgctgaggaactgagcccatcttcaccaatggatgcgtggatcctgagcaggttggccctggccgcacaggagtgcgaacgcggatttttgaccagggaattgtcactggtaacccatgccttgcaccacttctggctccacaatctctgtgatgtatacctggaggccgtcaagcccgttttatggcactcgcctcgacctttaggtcctccccaggttctcttctcttgcgccgatttaggtttgcggctgctggcccctttaatgccattcctggctgaggagctatggcaaaggctgcccccaagacccggttgtcctcccgctccctccatctcggtcgctccgtatccttctgcttgctccctggaacattggcgccagcctgagctggaaaggcgattttcacgcgtacaggaggtcgttcaggttcttcgtgctctaagagcaacgtaccagctcaccaaggcccgtcccagagtgctgctgcaatccagcgagcctggcgaccagggcctgttcgaagcctttctggagccactgggtaccctgggttactgcggagccgtgggactgctcccaccaggcgctgctgctccttccgggtgggcacaggccccactttctgacacagcacaggtatatatggaacttcaagggctcgtagatccgcaaatccaacttccactgctcgctgccagaaggtacaagttgcagaaacagctggactcactgactgcccgtacgccctcagaaggcgaagcaggcacccagaggcagcaaaagttatcctcactgcagctggagcttagcaaactcgacaaagctgcgtctcacctgcagcagcttatggacgagccgccagctcctggttcccctgaattatag

SEQ ID NO: 55858 - DNA, 3282 bp, Artificial Sequence
  Description of Artificial Sequence: Synthetic coding sequence
atggggggaaaggcctggccacgcagagctgtgggaacagccggaggcccttgtgccgaacagatcagcgcccctttccagacattattaatgcctcacctgccattggcgtctttccggcctcctttctggggccttcgccactctagaggcctaccacgttttcacagtgtttcaacacagtccgagccacacgggagtcccatttcccgcagaaatagggaagcgaagcagaaaaggttgagggagaagcaggctacactcgaggcagaaatcgctggcgagtctaaaagtcccgcagagtctattaaagcatggaggccgaaggaactcgtgctgtatgagatccctaccaagccaggcgaaaagaaggatgtgtctggcccactgccgcctgcatacagcccacgctatgtggaggcagcatggtacccatggtgggtccgcgaggggtttttcaagccagagtaccaggctcgcttgccgcaggcaaccggagagacgttctcaatgtgtattccaccacctaatgtaacaggttccttacatataggtcatgcgcttacggtcgctatccaggatgcgctagtgcgctggcatcggatgcgtggggaccaggttctgtgggttcctggatccgaccatgctggtatcgctacacaggcagtggtcgaaaagcagctgtggaaggagcgtggggtgagaagacatgagctgtccagggaggcgtttctgagagaagtgtggcagtggaaagaggccaaggggggtgaaatttgcgaacagttgagagccctcggcgcatccttggattgggatcgcgaatgcttcacaatggacgtgggctcgtcagtggcagtgactgaggcctttgtgagactttacaaagccggtctcctgtaccgtaatcatcaactcgtgaattggtcctgcgccctaaggagcgcaatctcagatatcgaagtggaaaatcgtcccctgccaggtcacactcagctacggctgccaggctgtccaacccccgtgtcttttgggctccttttttctgtcgcgtttcctgtggatggcgaaccagacgcagaggtagttgtaggcacaacacgcccagagaccttgcctggcgacgtcgcggtcgctgttcaccctgacgatagccggtacacacacctgcacgggcgtcaacttcgccatccactgatgggacagccgctgcccctaattactgactatgccgtacagccccacgttgggaccggtgctgtgaaagtgaccccagctcactcccccgcagacgccgagatgggcgcacgtcacggcctcagccctctcaacgtgattgcagaagacgggacgatgacaagcttgtgcggcgattggttgcaaggactccaccgctttgtggcacgagagaagataatgtctgtgttgtccgaatggggcctgttccggggtctccagaatcacccaatggtgctgcctatttgctctcggtccggggacgtgatcgagtatctgctgaaaaatcagtggttcgtccggtgccaggaaatgggagccagggccgctaaagcagtggaaagtggggcattagagctctctccatcctttcaccagaagaattggcagcactggttttctcacataggcgattggtgcgtgagtcgccagctgtggtggggacatcagattcctgcctacctggtggtcgaggaccacgcgcagggggaggaagactgttgggtggtcggcagatctgaggcggaagctagggaggtggccgcagagctgactggacgcccaggggcagagcttactcttgagcgagatcccgatgtgctggacacatggttttcttccgccctcttcccgttcagcgccctcgggtggccccaggaaaccccagacctggcacggttttaccccctgtccttgcttgaaactggctcagacctcttactcttctgggtgggcagaatggtcatgttgggtacccaacttaccggacagctcccattctctaaggtgttgcttcacccgatggtgagagaccggcagggcagaaagatgtccaagtcactggggaacgtgttggatcccagagatattatctcaggagtggagatgcaggtgttacaggagaaactccgaagcgggaacctggatcctgccgagctggcgatagtcgccgcagcccagaagaaggactttccacacgggattcctgaatgtggcactgatgccttgagattcacactttgctcacacggtgtacaggcaggcgacctccacctgtctgtgtccgaggtccagtcgtgcaggcacttttgtaacaagatatggaacgcactccggtttatcctcaatgctctgggagagaaattcgtcccccagcctgcagaagaattgagcccatcttctcccatggacgcatggatattaagtcgtctggccctggcggcacaggagtgcgaacggggatttctcacccgagagctcagcctcgtaacgcacgcccttcaccacttttggctgcataacctctgcgatgtgtatctcgaagccgttaagccggtgctctggcacagccccaggcctctgggcccacctcaggttttgttttcctgtgccgacctggggttaaggctgctggccccattaatgcccttcctcgctgaggagctctggcagcgcctgcccccacgtcctgggtgcccaccggcaccatcaatctcagtggctccttacccctcagcgtgtagcctcgagcattggcggcagccggagttagaacgccgattttctagagtccaggaggtcgtccaggtccttcgagcacttcgggcaacttatcaactaactaaagccaggccaagagtcttgctgcagtccagtgaacccggagatcagggccttttcgaggcattccttgagccgctaggaactcttggatactgcggcgctgtgggacttctgcctccaggtgcggcagccccatccggatgggcccaggccccactctccgatacagcacaagtgtacatggaattacaagggctggttgacccacagattcagctgccactgctggccgcacggagatacaagctccagaaacagctggatagtttaaccgcgaggaccccaagtgaaggcgaagccggtacccagcgccagcagaagctgagtagcttgcagctggagttaagtaagctagacaaagctgccagccacctacagcagcttatggatgagccacctgcccctggctcccccgaactttag

SEQ ID NO: 55859 - DNA, 699 bp, Artificial Sequence
  Description of Artificial Sequence: Synthetic coding sequence
atggcgagcagcgccgcatcgtccgagcattttgaaaagttacatgaaatcttccgaggcctgcatgaggatctgcaaggggtgccagagaggctcttaggaactgctggcaccgaagagaagaagaagctgatcagagacttcgatgaaaagcagcaggaggccaatgaaactctagcagaaatggaggaagagcttagatacgccccactgtcctttcgtaaccctatgatgtccaaactgcgcaattaccgcaaggatctggccaagctgcacagggaagtccgatctacacctctgacggccacccctggcggtcggggtgacatgaaatacgggatttatgcggttgagaacgagcatatgaatcgccttcaaagccagcgggctatgctgcttcaaggtaccgaatctctgaacagagcaactcagtccattgagagatcccatcgcatagccaccgagaccgatcagatcgggtctgaaattattgaagagctgggcgaacaacgcgatcagttggaaagaacaaagagccgcctcgtcaatacttccgaaaaccttagcaagagcagaaagattctccggtcaatgagtcggaaggtcactacaaataaacttctcctgagcattataattttgcttgaactggccattcttggcggtttagtctattataagttttttcggtcccactag

SEQ ID NO: 55860 - DNA, 426 bp, Artificial Sequence
  Description of Artificial Sequence: Synthetic coding sequence
atgcctcccaaattcaagagacatctgaacgacgatgatgttactgggtcggtgaagagtgagcggaggaatctgctcgaggacgatagcgatgaggaggaagatttctttctgcgcggaccctccggaccgagattcggccctaggaatgataaaataaagcatgtccaaaaccaggtggacgaggtaatagatgtaatgcaagagaacattaccaaggtcattgagcggggtgaacggctcgacgagctgcaagataaatcagagagtctgtccgacaacgctacggccttttcgaatcgatcaaaacaactgaggcgtcaaatgtggtggagagggtgtaagataaaggcaatcatggctctggttgcagccattctgctgttggtgattatcattctgatcgttatgaaataccgcacgtag

SEQ ID NO: 55861 - DNA, 423 bp, Artificial Sequence
  Description of Artificial Sequence: Synthetic coding sequence
atgcctccaaagtttaaaaggcacctgaacgacgacgacgtgaccggttctgtgaagagcgaaaggcggaatctactggaggatgacagtgatgaggaagaggatttctttctgggaccaagtgggccaaggttcggtccacggaacgataagattaaacacgtacagaatcaggtcgatgaggtgatcgatgtaatgcaggagaacataacaaaggtgatcgagcggggagagcgactggacgagctgcaggataagtctgaatcgttgagcgacaatgctactgcttttagtaatcgatcaaagcagcttcgtcggcagatgtggtggcgcggttgcaagattaaggccatcatggctctcgttgcggcaatcctccttctggtgatcataattctgattgtaatgaagtaccgcacttag

SEQ ID NO: 55862 - DNA, 423 bp, Artificial Sequence
  Description of Artificial Sequence: Synthetic coding sequence
atgccccctaagtttaaacgccacctgaacgatgatgacgttaccggctcggtcaaaagcgaacgccgtaatttactggaagatgacagcgatgaggaagaagacttcttcctcggccctagtggccctcgcttcggacctagaaatgacaaaatcaagcatgtgcagaatcaggtagacgaagtgattgatgtgatgcaagaaaacatcactaaggtcattgaacggggtgagcgccttgatgagttgcaggacaaatccgagagtctgtccgacaatgccacagcttttagcaacaggtctaaacaactccggaggcaaatgtggtggcgtgggtgcaagatcaaggccatcatggccctcgtggcggcaattctgctgcttgttattatcattcttattgtaatgaagtacagaacctag

SEQ ID NO: 55863 - DNA, 426 bp, Artificial Sequence
  Description of Artificial Sequence: Synthetic coding sequence
atgccccctaaattcaaaagacatctaaacgacgacgatgtgacaggatctgtcaaatctgaacgcagaaatcttctggaggacgatagcgacgaggaagaggacttttttctgaggggaccaagtggtccgagattcgggcctcgaaacgataagatcaaacatgtgcagaatcaggttgacgaggtcattgacgtgatgcaggagaatattactaaggtgatcgagaggggagagcggttagacgaactgcaagacaaatcagagtccctgtccgacaatgccaccgcattttctaatcgaagcaagcagctgcgccgtcagatgtggtggaggggttgcaagatcaaggcgattatggcactggtggccgctatcctcttgttggtaattattattctgatagtgatgaagtatcgcacctag

SEQ ID NO: 55864 - DNA, 519 bp, Artificial Sequence
  Description of Artificial Sequence: Synthetic coding sequence
atgagaagacaacccgctaaggtcgctgcactgctgctgggcctgcttctagaatgcacagaagctaaaaaacactgctggtatttcgaaggtctgtaccctacttattacatctgtcggtcctatgaggactgctgcggctcaagatgctgtgtgcgggcactgtccatccagaggctgtggtacttttggtttttgttgatgatgggtgtgctcttttgctgtggggctggcttttttattaggagacgcatgtacccaccacccttgatagaggaaccggctttcaatgtatcctacaccaggcaaccccctaatcctggaccaggggctcaacagcccggtcccccatactatacagatcccggtggtcccggaatgaaccctgtgggcaattcgatggctatggccttccaggtccctccaaactccccacaaggctcagtggcttgccctccccctcctgcttattgtaataccccccctccgccttacgaacaggtcgtaaaagcaaagtag

SEQ ID NO: 55865 - DNA, 510 bp, Artificial Sequence
  Description of Artificial Sequence: Synthetic coding sequence
atgctgagtgagacacttggatacctgtcctctgtgcttctccaatgtacagaggcaaaaaaacactgctggtacttcgaggggctttatcctacttactacatatgccgaagttatgaagactgctgtggcagtcgatgctgcgtgagggcgctgtctattcagcgactgtggtatttctggttcctcttgatgatgggtgtcctgttttgttgtggggcaggattttttatccgaagacggatgtaccccccacctctcatcgaagagcctgccttcaatgtcagctatacccggcaaccacctaacccgggacctggcgctcaacagccaggacctccctactataccgaccccggtggaccgggaatgaaccccgtggggaactctatggccatggcctttcaggtgccgccaaactcccctcaaggcagcgtcgcttgtcccccacccccagcttactgtaacaccccaccacccccatatgagcaggtcgtgaaagcaaagtag

SEQ ID NO: 55866 - DNA, 2196 bp, Artificial Sequence
  Description of Artificial Sequence: Synthetic coding sequence
atgctgaaggagtgggccatcaagcaggggatcctgttaaaagtggctgagacaatcaaatcatggattttcttttcgcagtgtaataaaaaagatgatctgttgcacaagttggatattgggttccggttggactccctccatacaatcttacagcaggaggtcctgctgcaggaggacgtcgagctgatcgagctgctggatccatcaatcctcagcgcaggtcaaagtcaacagcaggagaatggtcacctccccactttgtgctcgctggctacccccaatatatgggacctgagtatgttattcgcgtttatctctcttctggtgatgctgccaacatggtggatcgtctcatcatggcttgtgtggggagtcatccttttcgtttacctggttatccgggctctgcgcctgtggcgaactgctaagctacaggttacgctcaagaagtatagcgtacacctggaggatatggcgacaaacagcagggcctttaccaacttggtgagaaaggccctgcgattaattcaggaaaccgaagtgatctcaaggggcttcacattggtgagcgctgcctgcccgtttaacaaggcaggccaacatccttcccagcatcttattggccttcgcaaggccgtttacagaacgctgagagcaaacttccaggccgcaagactggccaccttatatatgctaaaaaattatccattgaactcagagtccgataacgtaaccaactacatttgtgtggtgcctttcaaagaattaggcctcggactttcggaggagcagatcagtgaagaggaagcccacaattttacagacggttttagcctcccagccctgaaagtgttatttcagctgtgggtagcacagagctcagagttttttagaagactggcactgctgctatccactgcaaatagccccccaggtcccttgctcacccctgctctgttacctcacaggatcctgagcgatgtaactcaggggcttccccacgcccactcagcctgtttagaggagttaaaaaggagctatgagttttatcgctacttcgagactcagcaccagtcagtgcctcagtgtctgtctaaaacccagcagaagagccgtgaactgaataatgttcataccgctgtgagatctctgcagctgcatctgaaggctctcctgaacgaggtcatcatcttggaggacgaactcgaaaagctcgtttgcaccaaggaaacccaggagctggtttcggaggcttatcctatccttgaacagaagctcaagttgattcaaccacatgtccaagcctccaacaactgttgggaggaagctatcagccaggttgataagctgctaaggcggaatacggacaagaagggcaaaccagagatagcctgcgagaaccctcactgtactgttgtgcctctgaaacagccgaccctgcacatcgccgataaagatcccatcccagaggaacaggagctggaggcctacgtggacgatatcgatattgactctgattttaggaaggatgatttttattacctgagccaggaggacaaggagagacagaagagggagcacgaggagtctaagcgggtactgcaggaactgaaaagcgttctcggcttcaaagcaagtgaggccgaaaggcagaagtggaaacaactcttattttccgatcatgctgtactgaaaagcctttccccagttgatccagtggagccaatctcaaattcagagccttcgatgaattccgacatggggaaagtttccaaaaacgacacagaagaggagtcgaataagtccgcaacgactgacaacgagatatcccggactgaatacctgtgcgagaattcattggagggtaagaataaggataattcgagcaatgaggtctttccccaaggagctgaggagagaatgtgctaccagtgtgagagcgaggatgaaccccaagccgatgggagcggattaacaactgcccctccaacccctcgcgactcgcttcagccgtccatcaagcaaagactggcccgactgcagctatcgccagattttacctttactgcaggtctggccgctgaagtcgcagcccgtagtctgtcttttaccaccatgcaggaacagacattcgggggtgaagaggaggagcagatcatagaagaaaacaagaacgaaatcgaggaaaagtag

SEQ ID NO: 55867 - DNA, 2340 bp, Artificial Sequence
  Description of Artificial Sequence: Synthetic coding sequence
atgctgccagacatggaagacgttcacctttttcagaacagccctctgtatcagtacctgcaggatctgggtcatacagatttcgaaatttgctccagcctcagcccaaagactgagaagtgcacaactgagggccagcagaaaccccctaccagggtcctgcccaagcaaggcattcttttgaaggtagccgagaccatcaagtcttggatctttttttcacaatgtaataaaaaggacgacctcctccataagctggatatcggttttagactagatagtcttcataccatcttgcagcaggaggtccttctccaggaagacgtcgagctcatcgagctcttggacccaagcattctgagtgctggtcagtctcagcagcaggagaacgggcatttaccaaccctgtgttccttagcgacgccgaatatttgggacctttccatgctcttcgcattcatttctcttctggtgatgttgccaacttggtggattgtgtcttcgtggctcgtatggggtgtcattctgtttgtttacttggtgattcgcgcactccggctgtggcgcactgctaagcttcaagtgactcttaaaaagtattccgtacacctcgaggatatggccaccaatagcagggccttcacaaacctcgtccggaaggcactccgcctcattcaggagaccgaggtgataagtagggggtttacactcgtgtccgcagcttgcccgtttaataaggcaggtcaacatccgtctcagcaccttatcggactcaggaaggcggtctataggacactgagggctaacttccaggccgcaagactggcgaccctatacatgctaaagaattaccccctcaactcagagtcagacaatgtcacgaattacatttgcgtggttccctttaaggaactgggtttaggcctgagtgaggagcaaatctccgaggaggaagcacacaacttcaccgatggcttctccctgcccgctctgaaggtactgtttcaactctgggtcgcgcaatcctcagagttcttccgcaggctcgcactccttttgtccactgccaactctcctccaggtcctctgttgacccccgcattacttccccacaggattctttcagacgtgacgcagggcctaccacatgcccatagtgcctgcctcgaagagctgaagagatcttacgagttctatcggtactttgaaacccagcatcagagcgttccacagtgtctatcaaagactcaacagaagtcccgggagctgaataatgttcatacagcagtgcggagcctccagcttcatttaaaagccctgcttaatgaagtgattatcttggaagatgagttggagaagctggtttgtaccaaggagacccaggaactggtgtcagaggcctatccgatcctggagcaaaagttaaagctgatccaacctcatgtgcaagcctccaataactgctgggaggaggcgatcagtcaagtcgataagctgttgaggcggaacacggacaagaaagggaagccggagattgcctgtgagaaccctcattgcaccgtggtgccgctgaaacagcccacattgcacatcgcagataaggatccaattccagaggagcaggagttggaagcctacgtggatgatattgatatagacagcgatttcagaaaggatgatttttactacctatcccaagaagataaggagcgacagaagcgggaacatgaagagtcgaaacgtgtattgcaggaacttaaaagcgtcctcgggtttaaagcatctgaggcagaacgccagaaatggaagcaactgctttttagcgatcacgccgtactcaagagtctatcgccagtggatcccgtggagcctatttctaatagcgaaccctccatgaacagcgacatgggaaaagtgtcaaagaatgatactgaggaagaatcaaacaaatccgctaccacagataacgagatttcccgcaccgagtatctctgtgagaactcactcgaggggaagaacaaagataattcctccaatgaggtgttcccgcagggggcagaagaacggatgtgctatcagtgtgagtcagaggatgagcctcaggcggatgggtcaggcttaactacagccccacctacccctagagatagcctgcagccgtcaatcaagcaacggctggctcggctgcagctgagtcctgactttactttcacagccggactggccgctgaggtagcggcacgttcactgtcatttaccaccatgcaggagcagacatttggtggtgaagaggaagaacagataatcgaagaaaacaagaacgagattgaggaaaaatag

SEQ ID NO: 55868 - DNA, 2340 bp, Artificial Sequence
  Description of Artificial Sequence: Synthetic coding sequence
atgactccagagttcgacgaggaagtggtgtttgaaaacagcccactgtatcagtatttacaggatttgggtcacacagacttcgagatctgcagctccctctctcccaagacagaaaaatgtacgacagaaggtcagcagaagccaccaacccgggtgctccctaaacaaggtatccttctaaaagttgcagagaccattaagtcttggattttctttagccagtgtaacaaaaaagacgacctcctccataaactcgacatcgggtttcgactggatagtctgcacacaatcctccagcaagaagtgctcctgcaggaagatgtagaactcatagaactgctagatccatccatcctgtccgcaggtcagtcccaacagcaagaaaacggtcatctcccaaccttgtgctcattggccacccctaatatctgggatttgtctatgctgtttgcattcatttctctgcttgtgatgttgccaacttggtggatcgtgtctagctggcttgtttggggagtaatcttgttcgtgtatttggtcatccgggctctgcggttatggaggaccgccaagctgcaagtcaccctgaaaaagtattccgtacatctggaggatatggctactaacagcagggcctttaccaacctggtcaggaaagctttacgactaatccaagagacggaggtgatctctagaggttttacccttgtgagcgcggcttgcccttttaataaggcagggcagcacccttctcagcatttgattggtctccgcaaggccgtctacagaacccttcgggcaaattttcaggccgcaagattggccacactgtatatgctcaagaattaccccctgaactccgagagcgacaacgtaactaattacatttgtgtagttcccttcaaagagttaggccttggcctgtcagaagagcagatctcagaggaagaagcccataacttcaccgacggattttcgctacccgcactgaaggtcctgtttcagctgtgggtggcccagtcctctgagttttttagaagattggccttactgttatctacagccaactcccctcctgggccactgctcaccccagcccttttaccccaccggatactttccgacgtcacacagggattgccccacgcgcactccgcttgtctggaggaactcaaacggtcctatgaattttatcgctactttgagacccaacaccaaagtgtacctcagtgcttgagtaagactcagcagaagtctagagaactcaataacgtgcatacagccgtccgatcccttcagctgcacctcaaggccctcttgaacgaggtgattatactcgaggacgagcttgaaaagcttgtatgtaccaaggagacccaggaactggtcagcgaggcctatcccatcctagagcaaaagctcaaactgatacagccacacgtccaagcatccaacaattgttgggaggaagctattagccaggttgacaagctgctgagaaggaatacagataagaaggggaagcccgagattgcctgtgaaaaccctcattgtaccgtggtgcccctgaaacaaccaaccctacatatcgcagataaagaccccatccccgaagagcaagagttggaagcttacgtggacgatatcgacatcgacagcgacttccgtaaggacgatttctactatttaagtcaggaagataaagagcgtcagaagcgcgagcacgaagaatcaaagcgagtgctccaggagctcaagtccgtcttgggcttcaaagcgtccgaggctgagaggcagaaatggaaacagcttctgttctccgaccacgcggtacttaagagtctgagccctgttgatcctgttgagcctatcagcaattcagaaccatctatgaactcagacatgggcaaagtctcgaagaacgatacagaagaggaatccaacaaatcagccacgaccgataatgagatcagtcggaccgagtatctttgcgaaaactctctcgagggaaagaacaaggacaattccagcaatgaggtgtttccacagggggcagaggaacgcatgtgttatcagtgcgaatccgaggatgaaccacaggcagacgggtcaggattaacaaccgcgccaccaacgcctcgagactcactgcaaccgagcataaaacagcgcctggcaaggctgcagttaagtcccgacttcacttttacagctgggttagctgccgaggtggctgccaggagcctttcttttactaccatgcaggagcagactttcggtggggaggaagaggaacaaatcattgaagagaacaagaacgaaattgaagagaagtag

SEQ ID NO: 55869 - DNA, 531 bp, Artificial Sequence
  Description of Artificial Sequence: Synthetic coding sequence
atggccgcacccgtgctgctgagagtttccgtgccgcgttgggagcgggtggcgaggtacgccgtgtgtgcagcagggattcttctctcaatttacgcatatcatgtggagcgggagaaggagcgcgatccagaacaccgggctctgtgtgacctgggaccgtgggtgaaatgttccgctgctctggctagcagatgggggagagggttcggtttattagggagtatatttgggaaagacggggtgctaaaccagcccaattctgtctttgggctcatattttacattctgcagctgctccttgggatgactgcctcagcagtggctgctctcatcttaatgacatctagtattatgtccgtcgtcggatctctgtaccttgcatacattctatatttcgtgctcaaggagttttgcattatatgcattgttacttacgtgctgaatttcttgctgctgataattaattacaagcggctagtctacttaaacgaagcttggaagcggcagctacagcccaagcaggactag

SEQ ID NO: 55870 - DNA, 306 bp, Artificial Sequence
  Description of Artificial Sequence: Synthetic coding sequence
atggaacggcctgataaggcagccttgaatgctctgcaaccaccagagtttaggaacgagtcttcactggcctccactctaaagacactcctgttctttacagccctgatgatcacagtaccaattgggttatacttcaccactaagagttatatctttgagggagccctcgggatgagtaatcgagacagttatttttatgctgcaatcgttgctgtcgttgccgtgcacgtggtgctagccctgttcgtctacgtggcctggaacgaaggctcaagacagtggcgcgaaggtaaacaggattag

SEQ ID NO: 55871 - DNA, 471 bp, Artificial Sequence
  Description of Artificial Sequence: Synthetic coding sequence
atgttgggttcgccctgcggcccacagctgagtgatagggacgcggacgaggatcagtgcagccgagaatttcgcggtcgtaggagtaggcgccctccccgacgaaccatgctgcgcggtaagtcacggttaaatgtggaatggctgggatactctcctgggttgctgctagaacaccgcccactgctggccggaagaacgccgaggagccaccgccgtaatgagagttccctggcatcaacactgaagactctgctattctttacagcgctcatgatcaccgtgcccattggcctttacttcactacaaagagttatatattcgaaggcgctctcggcatgtcaaatagagacagttacttttatgcggctatagtcgccgtggttgcggtacacgttgttctggccttgttcgtgtacgttgcgtggaacgaggggtctcgacagtggagggagggcaaacaggattag

SEQ ID NO: 55872 - DNA, 1188 bp, Artificial Sequence
  Description of Artificial Sequence: Synthetic coding sequence
atgacccacacattgtacccgacacccttcgcactctatccaatcaacattagcgccgcttggcacctgggtccacttccagtgtcctgttttgtgtctaataagtatcagtgttctctcgcttttggcgctacgacaggtctgagggtgctggttgttgtggttcctcagactcagctaagtttcctttcgtccctttgcctggtctcgctgtttctccactctcttgtgagcgcccatggggagaagccaactaaaccggttggtctcgatcctaccctgttccaagttgtcgtggggattttggggaactttagccttctgtattattatatgtttttgtattttcggggatataaacctcgttctaccgacttgatactgaggcatctgacagtagccgattccctggtcattctttcaaagcgcatccccgagaccatggcaacctttggcctgaaacacttcgataattacttcggatgcaagttcctgctttatgcacacagggtcggcagaggagttagcatagggagcacatgtctactgagcgtgttccaggtgattacaatcaatcctagaaatagcaggtgggccgagatgaaagttaaggcccctacatacatcggtcttagcaacattctctgctgggctttccacatgctagtgaatgccattttccccatttacaccaccgggaagtggtctaataataacataacaaagaaaggtgatttgggctactgctctgcacctttgtcagatgaagtgacgaaatcagtctacgcggctctgaccagcttccacgatgtcctgtgcctgggtctgatgctgtgggcaagctcctccattgtgctagtgctttaccgtcacaagcagcaggtgcagcatatctgccgaaataatctgtatccgaattcttcacccggtaacagggccatccaatcaattcttgccttggtgtccactttcgccctgtgctatgctctgagcttcattacgtacgtttaccttgctctgtttgacaacagtagttggtggctggtgaacacggcagcactgattattgcctgctttcctactatcagcccatttgtgttgatgtgccgcgatcccagccgtagtaggctgtgctcaatctgttgtaggcgtaacagacgtttttttcatgacttccgaaaaatgtag

SEQ ID NO: 55873 - DNA, 8487 bp, Artificial Sequence
  Description of Artificial Sequence: Synthetic coding sequence
atgcccaagagggctcattggggggcactatcagtcgtcttgattctgctttgggggcatccacgggtcgcgcttgcttgccctcatccctgcgcgtgttacgtgccatcagaggtgcactgtaccttccggagcctggcctctgtgccagccggtatcgcaaaacatgtggaaagaattaatttgggttttaacagcatccaggctctgtctgaaacatccttcgccggtctcacaaaacttgaactgctgatgatccatggcaatgaaattccctctatacccgacggagccttaagggacctctccagcctgcaagtgttcaagttcagctataataagctgagggtgattacaggacagaccctgcagggactatccaacctgatgagactccacatcgaccacaacaagatagagttcattcaccctcaagctttcaacggtttaacctcgctcagactactccatctagagggtaatttattgcaccagcttcaccccagtacattctccacattcaccttcctcgattattttagactctctaccattagacatctgtatttggcggagaatatggttcgaaccctgcccgctagcatgttgcgaaacatgcctctcctggagaacttatatctccagggtaacccttggacctgcgactgcgagatgcgatggttcctggagtgggatgcaaaatctcggggaatcctaaaatgcaagaaagacaaagcctatgagggaggccagctttgcgccatgtgtttctcccccaaaaaactctataaacatgaaatccacaaactcaaagacatgacgtgtttgaaaccatcgatcgagtcaccattacgccagaataggtcacggtcaatagaagaggagcaggaacaagaggaagatggcggatcccagctgattttagaaaagttccagctgccccaatggtctatctcgctcaacatgacagatgaacacggtaacatggttaacctggtctgcgacataaaaaaaccaatggatgtctacaagatccatctgaaccagactgaccctccggacattgacatcaacgccaccgtggcgctggactttgagtgtccaatgacacgggaaaactatgaaaaactgtggaagctaatcgcatactactccgaagtgcccgtcaagcttcatagggagctgatgttaagcaaggacccccgtgtaagctatcaatataggcaggacgccgatgaggaagcattgtattatacaggcgtgagagcccaaatcctggcagaaccagaatgggtcatgcagcctagcattgatattcagctgaatagaagacaaagtactgctaaaaaggtgctgttgtcctattatacccaatactcgcagaccatctcaaccaaagacacaagacaagctcgtggccgaagctgggtcatgatcgaaccttccggagcagtacagagagaccagactgtcctggagggcggaccgtgccagctgagctgcaatgtgaaagcaagcgagtccccaagtattttctgggtgttgccagacgggtccattctcaaggccccaatggatgaccctgactcaaaatttagcattttaagttcaggctggctgcgaataaagagcatggaacctagcgactccggcttgtaccaatgcattgctcaggttagggacgaaatggataggatggtgtacagagtactggtgcagtcgccatctacccaacctgctgagaaggatacagtcacgattgggaagaacccaggcgagagcgtcacattgccatgcaatgccctagccatcccagaagctcatttaagttggatcctgccaaaccgacggattataaatgatttagctaatacaagtcatgtctatatgctgcctaacggaaccctgagcatcccaaaggtccaagtttcagactcgggatactacaggtgtgtcgccgtaaaccaacaaggcgcagaccactttaccgttggaattactgtaacaaaaaagggctctgggctcccttccaaacggggtcggcgtcccggtgctaaggctttgtccagggtgagagaggatatcgtggaagatgagggagggagtggtatgggggacgaagagaacacttcgcgtcgtctactgcaccccaaagatcaggaagtgttcctgaaaactaaagacgacgcaattaacggcgacaagaaagcaaagaaaggacggagaaaactgaagctctggaagcacagtgaaaaggaaccagaaactaacgtggctgaaggccgtcgggttttcgaatccagaaggaggataaacatggctaacaaacagattaatccagagaggtgggccgacattctcgcaaaagtgcggggaaagaacttgccaaagggcacggaagtgccccctctcataaagacgacctccccaccctccttgtcattagaggttacacccccattccctgcaatctcaccgccatcagcgtcaccagttcagacagtgacaagcgcggaggagtcaagtgctgatgttccactgttgggggaggaagagcatgttctgggaaccatttcaagcgcctctatgggattggaacataaccataatggcgtcattcttgtggagcctgaagtgacttcaactcccctggaggaagttgtagacgacctatcggaaaagaccgaagagatcacatctacggagggggacttgaaagggaccgctgctcccaccctaataagtgagccttacgaacctagtcccacacttcacaccttggacaccgtgtacgagaagcccacccacgaggaaacagccactgagggatggtctgccgcagacgttggaagttcgccagaacccacatcatccgaatatgaacctccattagacgccgtgagcctcgcagaaagtgagcctatgcaatactttgatcctgatctggagactaagagccagcccgatgaggataaaatgaaggaggacaccttcgcccacctcacacccactcccaccatctgggtaaatgactcttctacaagtcagctgttcgaggattccaccataggggagcccggagtacccggtcagtcacatctacagggtctgacggataatattcatctggttaagagttccctctctacccaggatacactgctgattaagaaggggatgaaggaaatgtcccagaccctccaaggcggtaacatgttggagggggaccctacgcactccaggtccagcgaatccgaaggccaggagtctaagagtatcacactgcctgacagcacgctgggtatcatgtcttccatgagcccagtgaaaaaacccgctgaaaccactgtcggcacacttttggacaaagatactactaccgccaccacaactccccgacagaaggtcgctccctcgagcacgatgtcaacgcatccctctcggagaaggcctaatgggaggcgccgtttgcggccaaataagttccgccatcggcacaagcagaccccgcctacaacctttgcaccctctgagaccttttccacacagcccacccaagctcccgacatcaagatcagctcccaggttgagtcttccctggttcccacagcctgggtggacaacacagtcaacactccaaaacagctggaaatggaaaagaatgctgagccgacttccaaaggcacccctcgtagaaagcatggcaagaggccaaataagcatagatacacccctagcacagtgtcaagcagggccagtggatcaaaacccagccctagccccgagaacaaacaccggaacatcgtcacaccaagctccgagaccatcctgctcccgaggacggttagtctgaagacagaaggaccttatgacagccttgactacatgacaaccacgaggaagatctactccagctatcctaaagtacaagaaacgctgcctgtgacctataaaccaactagtgacggcaaagagattaaggatgatgtggccaccaatgtcgacaagcacaaatctgacatcctggttacgggggagagcattactaacgctattccaacgtctcgctctttggtttccacgatgggggagttcaaagaggaatcttctcctgtggggttccctggcacgcccacgtggaaccctagtcgaacagcacagccaggtcgcctgcagactggaatccccgttacgacaagcggcgaaaaccttactgacccacctctgctcaaagaactcgaagatgtggactttacgagtgaatttctcagttcgttaaccgtttctactcccttccaccaggaagaggcaggatctagcactacccttagctccataaaagtcgaagttgcatcatctcaggcggagaccacaactttggatcaagaccacctcgagaccacagtcgcgattttgctgtctgagacgagacctcagaaccacacaccaacagcagcgaggatgaaagagcctgcctcctcctcccccagcacgatcttgatgtcactgggccaaaccactaccaccaaacccgctttgccaagcccacggataagccaggcgagtagagattccaaggaaaatgtgtttctgaactatgtgggtaatcctgaaacagaagccacacctgtgaataatgagggcactcaacacatgtcaggcccaaatgagttatctacaccttcctcggaccaggacgcgttcaatttatccactaaactggagctggaaaaacaggtcttcggctcccgatcactgccccgtgggccagacagtcagcggcaggatgggagggtgcacgcctcccatcagctgaccagagtccccgcaaagccaatcctgcccaccgcaaccgtgcgattaccggaaatgtcaacacagagcgcctcccggtactttgttacaagccagtccccccgacactggaccaataagcccgagattactacgtaccctagtggggctctccctgagaacaaacaatttaccacacccaggttatcatcaactactatccctctgccccttcacatgtctaagccatcaatacccagtaaattcactgacagacggacagatcagttcaacggatatagtaaagtgttcgggaataacaacattccggaggccaggaatcccgtcggtaaacctccgtctccacgcatccctcactacagcaacgggaggttacctttttttacaaacaagacactgtctttcccccagttaggggttactcggagaccccagattcccacttcccctgcaccagtaatgagagagcgaaaagtgatccctggatcctataaccgcattcacagtcactcaacatttcatctggattttggcccacccgctcctccactcctccatactccccagactacggggtccccatctactaacttgcagaacatccccatggtgtcttcaacccagtctagcatcagcttcatcaccagctccgttcagtctagtgggagcttccatcagagctccagcaagttcttcgcagggggtccacccgctagcaagttctggtcactgggcgagaaaccacaaatattgaccaagtccccacagacggtgtccgtgaccgccgaaactgatacagtcttcccttgcgaagccaccggcaaaccgaagccctttgtgacatggacaaaagtttcgaccggagctctcatgacaccgaatacccggatccagaggtttgaggtgcttaagaacggcacactggttattagaaaggttcaggtgcaggatcggggacagtacatgtgtacggccagcaatctgcatggccttgatagaatggtggtactgctgtctgttactgttcagcagcctcagatcctcgcatcccactatcaggacgtcaccgtgtatctgggtgacacaatcgccatggagtgcctggcaaaaggcacacccgctccacagatcagttggatattccctgataggagagtgtggcagaccgtgtcccccgtagaaggcaggattactctgcatgaaaatcgtactctatctattaaagaggcttctttttctgataggggagtctacaaatgtgtggccagcaacgcagcgggtgccgattccctcgccatcaggctccacgttgcagccttgcccccagtgatacaccaggagaagctggaaaacatctcccttccaccaggactcagcattcatatccactgtaccgccaaggccgctccattgcctagtgttagatgggttctcggcgatggaacccagatcaggcccagtcagttcctgcacgggaatctatttgtatttccaaatggaaccctgtacatcagaaatctggcccctaaagattctgggaggtatgagtgtgtagccgctaacctggtagggtcagcacgcaggacagttcagttaaatgtgcagagggccgctgctaatgcgagaattacaggcactagccctcgaagaacagatgtgaggtatggaggaaccctgaaactggactgcagcgcaagcggcgacccttggcctaggatactctggagattgcctagtaaaagaatgattgacgcactgttttcattcgatagcaggataaaggtttttgctaatggcactctggtggttaagtcagtcaccgacaaggacgcgggagactacctgtgcgtggcacgcaataaggtgggggatgactacgtcgtgctcaaagtcgacgttgtaatgaagccagccaagatcgaacacaaggaagagaatgatcataaggtgttctacggaggtgatctgaaagtggactgtgtcgctacagggcttcccaacccagaaatctcgtggtccctgccagatgggagccttgttaatagctttatgcagagcgacgattcaggaggacgcacaaagcgatacgtcgtctttaataatggaacactatactttaatgaggtcgggatgagagaggaaggggactacacgtgttttgccgagaaccaggtgggaaaagatgagatgcgcgtgcgggtcaaagttgtcacggccccagctactatccggaacaaaacttatctggctgtacaggtgccatacggtgacgttgtgactgttgcttgcgaggcaaagggagaacctatgccgaaagtcacctggctctctcccacaaacaaagttatacccacgagctctgagaaataccagatataccaggacggtacactattgattcagaaggcacagaggagcgacagcggcaattacacatgtctggtccgtaactccgctggtgaagacaggaagaccgtgtggatacacgttaacgtgcagcctcccaaaatcaacggcaaccccaacccaataacaactgtgcgcgagattgcagcgggtgggtcccgcaaactaattgattgtaaggcagaaggaatccctacccccagggtcctgtgggcctttcctgagggggtggtgctgcctgccccatactacggcaataggatcacagtgcacggtaacgggtccctagacatcaggtcccttcgaaaatctgactcagtgcagctcgtctgtatggcaaggaatgaagggggtgaagccaggctgatcttgcagctcaccgtgctggagccaatggaaaaaccgatctttcatgacccgattagcgaaaagatcacagcgatggctggtcatactatctcactgaactgctctgccgcaggtacccctacccccagcctggtgtgggttctgcccaacggcaccgacctgcagtctggccaacaactgcagcgcttctaccataaggcagacggcatgctccatatcagcggactcagttccgtagacgccggtgcctacaggtgcgttgcgaggaacgcggcagggcacacggaaagactggtttcacttaaggtcggattaaaacccgaggccaataagcagtaccacaacctagtctcaattattaacggcgagaccttaaaactgccttgtaccccgcctggcgcaggacagggccgtttctcttggaccctgcctaatggaatgcatctggagggccctcagacccttggtcgggtctcgctgctcgacaacgggactctcaccgtgagagaagcgagcgtgtttgaccggggaacgtacgtttgccggatggagactgaatatggaccaagcgtgactagcattcctgtcattgttattgcctatccacccagaattaccagcgaacctactcccgttatctacacaagaccaggcaacaccgtgaaattgaactgtatggcaatgggcattcccaaggcagatattacctgggaactccctgacaagagccatttaaaggccggtgtgcaagccaggctgtacggaaatcggttccttcacccacagggctctcttactatccaacacgcaactcagagggacgcaggattctacaaatgcatggccaagaatatcctgggttctgatagtaaaactacgtacattcatgtcttctac

SEQ ID NO: 55874 - DNA, 1272 bp, Artificial Sequence
  Description of Artificial Sequence: Synthetic coding sequence
atggtgttcgcgttctggaaagtctttttgattcttagctgcctggctggccaggttagcgtggtacaggtcaccattcccgacggttttgtcaacgtgacagtcggtagcaatgtaaccctcatctgtatttacaccaccactgtcgcttcaagagaacagctgagtattcagtggtcattttttcacaaaaaggagatggagcctatctcccatagctcttgcctttcaacagagggaatggaggagaaggcggtatctcaatgtctgaaaatgactcacgctagggacgccagaggtcgatgctcttggacaagcgagatttacttcagtcagggaggtcaggccgtggccattggccagtttaaggataggataacgggaagcaacgatcccggtaatgcttctatcacaatttcacacatgcaaccggctgacagcggaatttacatctgtgatgtgaataacccaccggatttcctgggacagaatcagggaatccttaatgtgagtgtgctggttaaaccaagcaagccactttgcagcgttcagggaagacctgaaaccggacatactatcagcttgagttgcctctccgccctcggtacaccttctccggtttattactggcacaaactcgaaggcagagacattgtgccggtcaaggaaaacttcaatccaaccaccggtatactggttattggtaatttgactaactttgaacaggggtactatcagtgcaccgcgatcaacaggttggggaactcctcctgcgaaatcgatctgacgagttcgcaccccgaggtcgggatcatcgtcggagccctgatcggatccctcgtaggagccgcaataattattagcgtagtgtgcttcgcgaggaataaggcgaaggccaaagctaaggagcgaaattccaagaccatcgctgagctggaacctatgactaaaattaatcccaggggtgagagtgaagcaatgcctcgtgaagacgccacgcagttggaagtcaccctacctagcagcattcatgaaacgggacctgacacgatccaggaacctgattatgagccaaaacccacacaggagcctgcgccagaacctgcaccgggatctgaaccgatggcggtgcctgatctcgacattgagttggagctggaacccgagactcaatcagagctggagcctgagccagagcccgaacctgagagcgaacctggtgtggtagtcgagccactttcagaggacgagaaaggagtcgttaaggcgtag

SEQ ID NO: 55875 - DNA, 1623 bp, Artificial Sequence
  Description of Artificial Sequence: Synthetic coding sequence
atggccgcaggcggaagcgcgcctgagcctcgggtgctggtctgtcttggagcccttctggccggttgggtcgccgtgggcctcgaggccgtcgtgatcggcgaggtgcacgagaatgtgacacttcattgtgggaacatatccggactgcgagggcaggtcacttggtataggaacaatagtgaaccggtctttcttttgtctagtaactctagtttaagaccagctgaacccagattctccctggtcgatgcaacttccctgcatattgagtcactgagtctcggcgacgaaggaatctatacgtgtcaagagatcctcaacgtgactcagtggttccaggtgtggctacaggtggcttctggtccttaccagattgaggttcacatcgttgctactggcacactgccaaacgggaccctatacgccgctcggggtagccaggtggatttcagctgcaatagcagcagcagacctcctcctgtggtggaatggtggtttcaagccctgaatagctcgagtgaaagttttggacataacctcaccgtcaattttttctctctcctgctcattagcccaaatctgcagggcaattatacatgcctggcccttaatcaattgagcaagcgccacaggaaggtcactaccgagctcctcgtctactatcctcccccaagcgctccccagtgctgggctcagatggcgagtggctcgttcatgctccagctgacgtgtaggtgggacgggggttatcctgaccctgactttctgtggattgaggagcccggaggcgttatcgtcggaaagagcaaactcggagtggagatgttgtcagagtcccaattgagtgacgggaaaaaattcaagtgtgtaactagccacatcgtgggtcctgaatcgggcgctagttgtatggtgcagatcaggggacctagtctattgagcgagcctatgaagacctgttttaccgggggaaacgttactcttacatgtcaggtttctggagcctatcccccagccaaaatcctgtggctgaggaatcttacacagcccgaagtgatcatacagccaagttcccgacacctgattacgcaggacggtcagaatagcacactcacgatccataactgcagtcaggatttagacgaaggatattatatctgtcgagcggattctccggtgggcgtgcgtgagatggagatttggctgtcagttaaagaaccgctgaatattgggggaatcgtggggacaatcgttagcctgctcttacttggcctcgcaatcatttccggcctgcttctgcactatagtcccgtcttttgttggaaggttgggaacacaagtcgaggccaaaatatggacgacgtgatggtgctggtagatagtgaagaagaggaggaggaggaggaagaagaggaagaggatgcggctgtgggcgagcaggagggagccagagaaagagaagagcttcccaaagagatccctaaacaggatcatatccaccgggtgaccgcgctcgtgaatggcaatatcgagcagatgggaaacggctttcaagacctccaggatgattcgtccgaagagcagagtgatatcgttcaggaggaagaccggccagtctag

SEQ ID NO: 55876 - DNA, 2604 bp, Artificial Sequence
  Description of Artificial Sequence: Synthetic coding sequence
atggataacccccaggctctgcccctctttcttttgctcgctagcctagtgggcattttaacactgcgcgcttcatcaggcctgcaacagactaatttttcatcggctttctcgagcgacagcaagtcctcttctcaggggcttggcgtagaggtaccctctattaaacccccttcctggaaggtgcctgaccagttcttggactccaaggcaagcgccggtatctccgatagttcgtggtttcccgaggccctttccagcaacatgtccggtagtttttggtccaatgtttctgctgaggggcaagacctctcgcctgtgtcccccttttccgagacccctggaagtgaagttttccccgacatttctgacccccaggttcctgccaaagaccccaagccctcatttactgtgaagacaccggcatctaacatctcaacccaggtctctcacacaaaactctccgtcgaagcacctgatagcaagttttcacccgacgacatggacctgaagttgagtgcccagtccccggaatccaaattcagtgccgagacacattcagcagcgtcttttcctcagcaagttgggggtcccttagccgtgctggtgggaaccactatccgactccctctagttccaataccaaacccagggcctccgacatccttagttgtctggaggaggggaagtaaggtgcttgcggctgggggacttggacccggagcccctctgatttctctcgaccccgcacaccgggaccaccttagattcgatcaagcacgaggcgtcctagaattagcatcggctcaactcgacgacgcaggagtgtacacggctgaagtgattagagccggagtttcacaacagacccacgaatttacggtgggggtctatgaacctctgccccagctgtccgtccagcctaaagcgccagaaactgaagagggtgcggcagaactgagactgcgctgtctgggctggggccctggtcggggagagctgtcttggtccagggatggcagggccctcgaggctgctgagtccgagggagcagagacgcctagaatgagatccgagggcgaccaactactcattgtccgacccgtgcgctccgaccacgccaggtacacgtgccgcgttaggtctccgttcggacatagggaagctgccgctgatgtgtcggtcttctatgggcctgatccacccacaatcacagtgagcagtgatcgcgatgcagctcctgcacggttcgtcaccgctggcagcaatgtaaccctgcggtgtgcagcggcttctaggcctcctgcagatataacctggtccctggctgaccctgctgaggctgccgtcccagctgggtccagactactgctccccgctgtagggcctggtcatgctggtacctacgcttgcctggctgccaacccacggactggcagacggaggaggtctcttcttaacctcaccgtggcagatctgcccccaggcgcacctcagtgctcagtagaggggggaccaggggaccgctcactacgcttccgatgttcatggccaggcggagctcctgccgcttccctgcagtttcagggtttaccagaaggtatccgcgcaggcccagtctctagcgtcctgctggctgccgttccggcacatcctcgcttgtctggggtgccaattacatgcctagctagacatttggtcgccacccgcacatgtacagttacaccggaagcaccccgtgaggtcctgttgcaccctcttgtagccgagacgcggttaggagaagccgaggttgcactggaagcatccggatgtccccctccaagtcgtgcttcatgggcacgggagggacgacccctggcaccgggtggcggttctcggctgcggctttctcaggacgggagaaaactgcacatcggaaattttagcctggactgggacttgggtaactactccgtgctgtgtagcggagctttaggcgctggcggtgatcaaattacactcattgggccttctatcagcagttggagactgcagcgcgcacgagatgcggctgtgttaacatgggatgtggagcggggagcactgatttcttccttcgagattcaggcatggcccgacgggcctgcgttaggtcggaccagtacctaccgcgattgggtgtccctgcttatccttggccctcaagagcggagcgccgtggtgcccttgccacccagaaatcccggtacttggacttttagaatactcccgatcctgggcggtcagcctggcaccccctcacagagtagggtgtatagggctggaccgactctcagccatggagcgatcgccggaattgtgctgggttccctgctgggcctcgcattgcttgcagtgcttctcctgctctgcatctgttgtctttgcagatttcgcggtaaaacacctgagaagaaaaaacatcctagcactttagtgcctgtggtcactccttccgaaaagaaaatgcacagcgtgacgcccgttgaaatatcatggccacttgacctgaaagtgcccctggaagaccactcatccacccgggcatatcaggcccagacacctgtgcagctttccctctag

SEQ ID NO: 55877 - DNA, 147 bp, Artificial Sequence
  Description of Artificial Sequence: Synthetic coding sequence
atggataacccacaagcattgcccttgttccttttactagcaagtctcgtcggcatcctgaccttgagagcttcctcaggactccagcagaccaatttttcttccgcactgcaccgcgcattctgggctcggacgtcatacttttag

SEQ ID NO: 55878 - DNA, 1200 bp, Artificial Sequence
  Description of Artificial Sequence: Synthetic coding sequence
atgggcattctcttgggactcttattgttaggacacctgactgttgatacctatgggaggccaatcctggaggtaccagagagcgtcacagggccatggaagggagatgtaaacctcccctgtacttatgaccccctgcagggttatacccaggtactggttaagtggctggttcagaggggctccgatcctgtcaccatctttctgcgcgatagttcaggggatcacatccagcaagccaagtaccaaggtcgtctgcacgtcagccataaggtaccaggtgatgtttctttgcagttaagtaccttggagatggatgatcgctcccattacacttgcgaggtaacttggcagacccctgatggaaatcaggttgtgcgagataaaatcaccgaacttagagtgcagaaactgtcagtgtccaagccaactgttaccaccggtagcggatacggtttcactgtgccgcaggggatgagaatttccctgcagtgtcaagctagaggatccccacctatatcttacatatggtataaacaacagacaaacaaccaagaacccataaaagtggccacattatctaccctgctgtttaagccagcggtgatcgccgattctggcagctatttttgtaccgcaaaaggacaagtggggtccgagcagcatagcgacatcgtgaagtttgtagtcaaagactctagcaagctactgaagacgaaaaccgaagcgcctacgaccatgacctatccgctgaaggcaacatctactgttaaacagagctgggattggacaactgacatggatggctatctcggcgagacatctgccggaccaggtaagagtctcccagtgttcgcgatcatcttgatcatcagtctgtgctgcatggttgtgttcacgatggcatacataatgttatgccggaagacaagccagcaggagcatgtatatgaggctgctcgggctcatgctcgcgaggcgaatgatagcggagagacaatgcgggttgccatcttcgccagtgggtgttcctctgatgaaccgacctcacagaatctaggcaataattatagcgatgagccctgtattggacaggagtatcagatcatcgcccagattaacgggaattatgctaggcttctggacaccgttccactggattacgagttcttggcaactgaggggaagagcgtatgttag

SEQ ID NO: 55879 - DNA, 918 bp, Artificial Sequence
  Description of Artificial Sequence: Synthetic coding sequence
atgggtatcctccttggcctgctacttctggggcatcttacggtggacacatacggccgacctatcttagaagtgcctgaaagcgtcacaggcccatggaagggtgatgtgaatctaccgtgcacctacgatcccctccagggctatactcaggttcttgtgaagtggctggtacagaggggttctgatccagtcacgattttccttagagactcctcaggagatcacatccagcaggcaaaatatcagggcaggttgcacgtgtcacataaggtgccaggcgatgtgagcctccagctctcaacgttggagatggacgaccggtctcactacacctgtgaggtcacatggcagacaccggatggcaaccaggtcgtaagagacaagattaccgagctgagggtgcagaaacattcgtctaagctgttaaagaccaaaaccgaagccccaacaaccatgacgtaccctctgaaggctactagcacagtaaagcagtcttgggactggacaactgatatggacgggtatctgggcgagacaagcgccggacctggaaagtcgttacctgtcttcgcaatcatactcattatcagtctgtgttgcatggtggtcttcacaatggcttacatcatgctttgcagaaagacaagtcagcaggaacatgtctacgaagctgccagggcccacgcacgggaggcaaacgactccggcgaaacaatgcgagtcgcaatatttgcatccgggtgcagcagtgatgaaccgactagccagaacctagggaacaactatagcgacgagccctgcattggacaggaatatcaaatcattgcccaaataaacggaaactatgctcggctgctcgataccgtgcccttggattacgagtttctggctacagaaggcaagtcggtttgctag

SEQ ID NO: 55880 - DNA, 606 bp, Artificial Sequence
  Description of Artificial Sequence: Synthetic coding sequence
atgggaatcctactcggtcttcttctcttaggacacctgactgtcgacacgtatggacgaccgatcctggaagtgccagagagtgtgactggaccctggaagggggatgtgaacctcccctgtacctacgatcccctacagggttatacccaagtgttggtgaagtggctcgttcagcgtggctctgaccctgtgactactgtaaccaccggatccggatacgggtttacggtgcctcagggcatgagaattagcttgcagtgtcaagcccgtggcagcccaccaatatcttatatttggtataagcaacaaactaacaaccaagagcctatcaaggtcgccacattatccactttactcttcaaacctgctgttattgccgattctggaagttacttctgtactgctaagggtcaggtggggtcagagcagcactctgacatcgtcaaatttgttgtgaaggatagcagtaagttgctgaagacaaagaccgaggcgccaacaaccatgacttatcccctgaaggcaacctctactgtcaagcagtcttgggattggaccacagatatggacggttacttgggtgagacctccgcgggtccctag

SEQ ID NO: 55881 - DNA, 825 bp, Artificial Sequence
  Description of Artificial Sequence: Synthetic coding sequence
taggaccacatccagcaggccaagtaccaagggagactgcacgtttcccataaagtaccaggagacgtgtctctccaactgtctacattagagatggatgatcgcagtcactacacctgtgaagtgacatggcagacacctgacggtaaccaggtagtaagggacaaaataactgagctacgcgttcaaaagttgtctgtttccaaacccactgtgaccacagggagtggttacgggttcaccgtaccacagggcatgcgaatatcgctccagtgccaggccagggggtccccacccatctcttacatttggtacaagcaacagaccaataaccaggagccaatcaaggtggccacactctccactctactatttaagccagccgtgatcgctgattctggcagctacttttgcacagctaaagggcaggtcggctccgagcagcattcagatatagtcaagtttgtggtcaaagactcaagcaagttacttaagacaaaaacagaagctccaaccacaatgacatatccccttaaggcgacttccactgtgaagcagtcatgggactggaccactgacatggacggctatttaggcgagaccagcgccggacccggtaaatctttgccagtgttcgccattattctgattatctccctgtgctgtatggtagtcttcactatggcgtatataatgctttgtcgcaagacctcccagcaggaacacgtgtatgaggccgcatccccgaaatgccctcctacgaatacaggggcagcagggtcacattggctatgccccggaatttgccagatgcatctaaagtag

SEQ ID NO: 55882 - DNA, 966 bp, Artificial Sequence
  Description of Artificial Sequence: Synthetic coding sequence
atggggatacttctgggcctcctgctgctgggtcacttgaccgttgacacttatggccgaccgatactggaagtgcctgagtctgtcacgggaccttggaagggcgatgtgaatctcccttgtacctacgatcccctccagggatatacacaagtcctggttaagtggctggtgcagcggggatccgatcccgtcaccattttcttgcgagatagtagtggggaccacattcagcaggccaaatatcaggggcgactgcacgtgtcccacaaggtaccgggtgacgtgagcttgcaattgagcacactcgagatggacgacagaagccactatacatgcgaggtgacttggcagactcccgatggcaaccaggtagtaagggataaaattactgaattaagggtgcagaagctgagtgtctcaaaacccaccgttactacagggtccggttacgggttcaccgtcccacagggcatgcgcattagtctgcaatgccaggccagaggcagcccaccaatctcctacatctggtataagcagcaaaccaataatcaggagccaatcaaagtagcaaccctgagcaccttactatttaagcctgcagtcatcgccgactctggtagttacttctgcacagctaaaggacaagttggtagtgagcagcattccgatatcgttaagttcgtcgtaaaagactcctccaagctgctgaagacaaaaaccgaagcccctacaacgatgacctacccgctgaaggctacatcaaccgtgaaacagagttgggactggaccaccgacatggatggctaccttggagaaactagcgccggacctggcaagtccctgcccgtctttgccatcatccttatcattagtctgtgctgcatggtggtcttcactatggcatacatcatgctctgtagaaaaacctcccaacaggagcatgtctatgaggcagctaggtag

SEQ ID NO: 55883 - DNA, 1245 bp, Artificial Sequence
  Description of Artificial Sequence: Synthetic coding sequence
atgcgggtgggtggtgcctttcacttgctacttgtgtgtctgagtcccgcattgctctctgcggtgagaatcaacggggacgggcaggaggtgctgtatctggccgagggagacaacgtcagactgggttgcccatacgttctcgaccccgaggattatggccctaacggactggacattgaatggatgcaggtgaatagcgacccagcccatcaccgagagaacgtttttttatcctatcaggataagcggattaaccatggttctcttcctcatctgcaacagcgcgtgcgatttgcagcctcagacccgtcccaatacgatgcctccattaatctaatgaaccttcaggtatctgatacagcgacttatgagtgtagggtcaagaagacaaccatggcaacccggaaggttattgttaccgtacaggcacggccagctgtgcccatgtgttggaccgaaggccacatgacctacggcaatgatgttgtcctcaaatgttatgcatcgggcggaagtcagccactgagctacaagtgggcaaagattagtggccaccattatccatatagagcagggtcctatacaagccagcatagctaccactcagagttgtcctatcaggaatcctttcattcctctatcaatcagggactgaacaacggtgacctagtgctgaaagacatttctcgggctgacgacggcctttaccagtgcactgtggcaaacaatgtaggctacagtgtgtgtgtggtggaggtcaaggtctcggattctcggaggattggggtgatcatcggcatcgtgctaggaagcctgcttgcgctcgggtgtcttgcagtcgggatctggggacttgtctgttgctgttgtggaggatccggagcgggaggagctcggggagctttcgggtacggcaatgggggtggcgtgggcggaggagcttgtggggacctggcttcagaaatcagagaagacgctgttgcacccggttgtaaggcatctggtcgaggttcaagggttacccacttactgggatatcccacgcagaatgtatctcgctcgctccgtaggaaatacgcgcctcctccatgtggaggcccagaagacgtggctctcgctccttgcaccgccgctgccgcttgtgaagctggccctagccccgtgtacgttaaggtgaagagcgccgagccggcagattgcgctgaagggcctgtgcagtgcaaaaatggactgcttgtgtag

SEQ ID NO: 55884 - DNA, 576 bp, Artificial Sequence
  Description of Artificial Sequence: Synthetic coding sequence
atgagattgctcgctctcgctgctgccgcattgttagcaagggcaccagctccagaagtatgcgctgctctcaatgtaacagtgtcacccggtcccgtggtagattacctggagggagagaacgcaactttgctgtgccatgtcagtcagaagcgtcggaaagacagtctgctggccgttagatggttttttgcccacagtttcgattcacaagaagcccttatggtgaagatgactaaattgagagtagtccaatattacgggaattttagtagaagcgccaaacgacgacggttacgattgctggaggagcaacgaggggcattatacagactgagcgtgttaacactccagccctcagaccagggtcactacgtatgtcgggtgcaggaaatttcacggcacaggaacaagtggacggcttggtctaacggcagtagcgctacggagatgcgcggagtttcctctcacccagtggagcgcggagccttcctcggaatctccctcgtgattttgccgcatagcctgccctttactgcggacttgaccatggcgtcattccttcaatcctcctag

SEQ ID NO: 55885 - DNA, 963 bp, Artificial Sequence
  Description of Artificial Sequence: Synthetic coding sequence
atgcgcttacttgccctagcggcagcggctttacttgcccgtgctcctgcccctgaagtgtgtgccgcactgaatgttaccgtgagtcccggacctgtcgtcgattacttggaaggtgagaatgcaactctgctatgtcatgttagccagaaaaggcggaaggacagcttgctggccgtgagatggttcttcgcccattccttcgactcacaagaggccttaatggtgaagatgaccaaactgcgagtcgttcagtactatggaaatttctccaggtctgcaaaaaggcgccgacttaggctcttggaagaacaacgcggtgcactgtatcgcttatcagtgctgactctgcagccatctgaccaagggcattacgtgtgtagagtgcaggagatcagccgacaccgtaacaagtggaccgcttggagcaacgggtctagtgcaaccgaaatgagagtgatatctctgaaagcctccgaggaatcctcctttgaaaaaactaaggagacatgggccttcttcgaagacctatacgtttatgctgtgctggtctgctgtgtcgggattctctctatactgctctttatgctcgtgattgtctggcaatcagtctttaataagagaaagtcccgggtacgccactatctcgttaaatgcccgcagaattcgtcgggagaaacagtcaccagtgtgacttcactggcaccacttcaacctaagaaagggaaaagacagaaggagaagcccgacattccacctgccgtgccggctaaggcacccatcgctcctacttttcataaacccaagttactgaaaccacagagaaaggtgactctgccaaaaattgccgaggagaacctcacctatgctgaactcgaactcataaagccccacagggctgcaaaaggggctccgacctcaacagtgtatgcgcagatcttatttgaagaaaataagctctag

SEQ ID NO: 55886 - DNA, 603 bp, Artificial Sequence
  Description of Artificial Sequence: Synthetic coding sequence
atgaggcctctcccatcaggacggcgaaagacccgtggcatcagcttaggcctgtttgcattgtgtttggcagctgctaggtgtctccaatcccagggagtgagcctgtacataccacaggcaactataaacgccacggtgaaagaggatatcttactcagcgttgagtattcctgccacggtgtgcccactatcgaatggacttacagtagcaactgggggacacagaaaatcgtcgagtggaagccaggcacccaagcgaacatttcccagtcccataaggatcgagtgtgtaccttcgacaacgggtcgattcagctgttctccgtgggagtgagggacagtgggtattacgttataaccgtgactgaaaggctaggatccagccagttcgggaccattgtcctccacgtgtcagagatcttatacgaggacctccatttcgtcgctgtgatccttgcttttctggcagcagtggccgctgtcctgatttctctgatgtgggtgtgcaataaatgtgcatacaagttccagcgaaagcggaggcataaactaaaagaatctaccacagaagagatagagctggaggacgtggagtgctag

SEQ ID NO: 55887 - DNA, 501 bp, Artificial Sequence
  Description of Artificial Sequence: Synthetic coding sequence
atggcatccctgggtcagatcctgttttggtccataatcagtatcattatcatactcgccggagcgatagctctgatcattggttttgggatctcagcttttagtatgccggaagtgaatgtggattataacgcttcatcagaaactctgcggtgtgaggccccacggtggttcccacaaccgaccgtggtgtgggcaagtcaggtcgaccagggtgccaacttctcggaggtgagtaatacttcatttgagctcaacagtgagaatgtcaccatgaaagtggtaagcgtactgtacaatgtgacaattaataatacgtattcatgcatgatcgagaacgatatcgccaaggctacaggcgacatcaaagtcactgagtccgagattaaaagacgttcacacctccagctcctcaattctaaagccagtttgtgcgtgagctcgttcttcgcgataagctgggctctgctgccgctcagtccttacctgatgctgaagtag

SEQ ID NO: 55888 - DNA, 858 bp, Artificial Sequence
  Description of Artificial Sequence: Synthetic coding sequence
atggtcctcttgacttcaaggatgaagccccttacttcgaggataatctctattattataatccttgctggggcaatcgccctgataataggatttgggatttccggcagacactctatcaccgtcacaacagttgcctccgccggtaacatcggggaggacgggatactcagctgcaccttcgagcctgacattaaactgagtgacattgtgatccagtggcttaaggagggggtgctcggtctagtccacgagtttaaagagggcaaagatgaactttccgaacaggatgagatgtttcggggaaggacagcagtcttcgctgatcaggtcatcgtgggaaatgcatcactcagacttaaaaatgtgcagttaaccgatgccggtacttacaagtgctatatcattacaagtaaaggcaaagggaatgccaaccttgagtacaaaaccggggcattttccatgcccgaagttaacgtggattataacgcatcgagcgaaaccctgcgttgtgaagctccccgttggttcccacagcctactgtagtttgggcttcccaggttgatcagggtgctaatttttcagaggtgagcaacacctcctttgaactcaacagcgagaatgtgactatgaaagtggtgtccgttctgtacaacgtaacgatcaacaatacctattcatgcatgatcgaaaacgacatagccaaggccaccggcgacatcaaggtgaccgagtcagagatcaagcgacgctctcacctgcagctgctcaacagcaaggcaagtctgtgcgtttcatcttttttcgccatttcttgggcgctgctcccactgagcccttacctgatgctgaagtag

SEQ ID NO: 55889 - DNA, 258 bp, Artificial Sequence
  Description of Artificial Sequence: Synthetic coding sequence
gccacattgcggaataagctgatgtggaatattattagcatcatcatcattcttgctggcgctattgccctgattatcggattcggcatttccgaagtgtcagtctggctgtctgctatgaaggggtgccgatcaagcaaggcaagcctgtcaatcgacttgtgcttcctgaactgccgtgagactctacatcactcccattactgtagactcagctgggaacactggggaggttggaatcctgagctccatttctag

SEQ ID NO: 55890 - DNA, 849 bp, Artificial Sequence
  Description of Artificial Sequence: Synthetic coding sequence
atggcatctttgggccagatcctgttttggtccattatctcgattatcatcattttagccggtgcaatagcattgatcatcgggtttgggatcagcggacgccactccatcacagtcacgacagtggcgtccgctggcaacatcggcgaggatggcattctgagctgtacgttcgaaccggacattaagctctcagatattgttatacagtggctgaaggagggggtgctcggtttggttcacgaattcaaggaggggaaggacgaactgtccgaacaggacgagatgtttcgcggaagaactgctgtcttcgcggaccaagtgattgtgggtaatgcctctctccgcctgaagaacgtacagctgacagatgccggaacttacaaatgctatattatcaccagtaagggcaagggaaatgccaacctcgagtataagacaggagctttcagtatgccagaagtgaatgttgactacaacgccagttccgaaacgctgcgttgcgaggcaccccgatggttccctcaacctacagtggtctgggcttcccaggtcgatcagggggcaaacttttctgaggtcagcaacactagctttgagttgaacagtgagaacgtgaccatgaaggtcgtctccgtgctttacaatgtgaccatcaataacacttattcatgcatgatagagaacgatatcgcaaaggccaccggcgacattaaagtgacagagtccgagatcaaacgtcgttcccacctccaactgctcaattctaaagcgtccctatgtgtctctagttttttcgcaatttcttgggctctgctccccctgtctccctatcttatgttgaaatag

SEQ ID NO: 55891 - DNA, 564 bp, Artificial Sequence
  Description of Artificial Sequence: Synthetic coding sequence
atgttccgaggacggactgcagtgttcgccgaccaggttattgtgggcaatgcatctcttagactgaagaatgtccagttgactgatgccggtacatacaaatgctacattatcacctccaaaggaaagggcaacgccaatctcgagtataagaccggggcattctctatgccagaggtgaacgtggactacaacgcttccagtgaaacgctcaggtgtgaggccccaagatggttccctcagccaaccgttgtgtgggcaagccaggtggaccagggggcaaatttttccgaggtaagtaacaccagtttcgagctgaacagtgaaaatgtcacgatgaaggtggtgtcagttctatataacgtgaccattaacaatacatatagttgcatgattgaaaacgatattgccaaagcgacaggggacataaaggtaaccgagtccgagattaagagaagatctcatctgcagctcctgaatagtaaggcttcgctgtgtgtcagcagcttcttcgcgatttcatgggcccttcttccactgagcccttatttaatgttaaagtag

SEQ ID NO: 55892 - DNA, 1434 bp, Artificial Sequence
  Description of Artificial Sequence: Synthetic coding sequence
atgtccggtgtgatgtgtttgaaggcaagtgatacctgggcctccggaattagatcacagccacagggatgcctgggaaagtggcgctctatgaggtgtaagcatacccggatgcacctcgcccacctcggtaattctagacagctgattagccttgggcctcctcgtacgagagaagacggctccaggatcagtcaacaagtcgagcagtcacggtcgcaggtccaggctattggcgaaaaagtgtccctggcccaggctaagatagagaaaataaagggcagcaagaaggccattaaagtcttctcttccgctaaatatccagccccagaaagacttcaggaatacggctccattttcaccgacgcacaagaccccggtctccagagacgcccacggcaccggatccagagcaagcagaggcccctcgatgaacgcgctcttcaggagaaactgaaagattttcctgtctgtgttagtacaaagcccgaacccgaagatgatgctgaagaaggcctgggtggactcccttctaatataagctccgtgtcaagcttgctgctgtttaacaccacagaaaacctttacaaaaaatacgttttcctggatccccttgctggggctgtaacaaaaacacatgtgatgctgggtgcggaaaccgaggagaagctcttcgatgcccctcttagcatctctaagcgtgagcagctcgagcagcaggtccctgagaactacttctatgtgcccgacctgggacaggttcctgaaatcgacgtgccctcctatctgcccgacctccctggcatcgcgaatgatctgatgtacatcgctgatctcgggccaggcatcgccccaagtgctcctgggaccatccctgagctacccacttttcatactgaggtggctgagccactcaaagtggatctgcaggacggcgtgttgacccctcccccaccacctccgccacccccacccgctccagaggtactcgctagcgccccaccgctgccaccatctaccgcggctccagttgggcagggagcacgccaggacgacagcagctcatcagccagtccttcagtgcaaggggctcccagagaggtcgtagacccctccggcggatgggcgaccctcctggagagcattcggcaggcaggcggaatcggcaaagcgaaattgagatcaatgaaggagcgcaaacttgagaaacagcagcaaaaggagcaggaacaggtgagggcgacctcccaggggggacacctgatgtccgatctgttcaataaactcgtaatgcgtagaaaggggatctccggaaaaggaccgggagcaggcgacggcccagggggtgcttttgctcgtgtctcggattccatccctcccctcccaccgccacagcagccccaggccgaggacgaagatgattgggagtcatag

SEQ ID NO: 55893 - DNA, 510 bp, Artificial Sequence
  Description of Artificial Sequence: Synthetic coding sequence
atgagtggagaaatggctttccatgagatgcaagcacacaagaacgccctgggaacctccggcgaacagcaggccgctgatataactggacctaccccccaccagggcggatggaaacaggtagagcagagcaggtcccaggtccaagccatcggtgaaaaggtgagtctggcccaagccaaaattgaaaagatcaagggttcaaagaaagctatcaaggtgttttctagcgctaaatatcccgctcctgagaggctgcaggaatacggcagcatcttcactgatgcccaggatcccggactgcaacggcgaccgagacatagaattcaaagcaagcaaagaccactggacgagcgggcactgcaggaaaagctcaaggactttcccgtttgcgtgtccactaaaccagaacccgaggatgacgcagaggagggcctcggtggacttcccagcaacattagctcagttagttcccttctacttttcaatacaacggaaaatctgtattag

SEQ ID NO: 55894 - DNA, 1344 bp, Artificial Sequence
  Description of Artificial Sequence: Synthetic coding sequence
atggctttccacgaaatgcaggcccacaaaaatgctctgggcacctcgggcgagcagcaggccgctgacatcaccgggccaaccccccaccaaggagggtggaaacaagttgagcagtctagatcacaggtgcaggccatcggagagaaggtgtcactggctcaagcgaaaatagagaagatcaaaggaagcaagaaggccatcaaggtgttctcaagcgctaaatatccagcgcctgaaagacttcaagaatatggctccatttttactggagcacaggatccaggattacaaaggcggccacggcataggatacagtctaagcacagacccttagatgagagggccttgcaagaaaagcttaaagatttccccgtctgtgtgtccaccaagccggagcctgaggatgatgccgaggaagggctggggggactgccttctaatataagctccgtgagcagcctgctgctttttaatacaaccgagaatctctacaagaagtacgtgttcctcgaccctctggctggggctgtcactaagacacatgtcatgctgggggcagaaaccgaagaaaagctttttgacgctcccctctctattagtaagagggagcaactggagcagcaagtgcctgagaactacttttacgtccctgacctcgggcaagtccccgaaatcgacgttccttcctatctacctgacctccccagtattgctaacgacctaatgtactcagccgacctcggccctggaatcgcgccttccgcccctgggactattcccgaactgccaacatttcacaccgaagtggcagagcccttgaaggcggatctccaggacggagtgctgactcctccccctcctccgccaccgccaccacctgcacccgaggttttggcctcagctcctccactgccccctagcaccgccgcacccgttgggcaaggagcacggcaagatgacggcagcagcagcgcttcaccaagtgttcagggagcgccaagagaagtggttgatcctagcggagggtgggcaactcttcttgagtctataagacaagccggagggatcggcaaggcaaagctgagaagtatgaaggaacggaagctggagaagaagaaacagaaggagcaggagcaggtccgggcaactagccagggaggccatctcatgtctgatttgtttaacaagctagtgatgcgcaggaaagggatttccggaaagggcccaggcgctggagaggggccagggggagcattcgctcgcgtctcggattccattcctccggttccccctccccagcaaccgcaagctgaggaggatgaagacgactgggaatcgtag

SEQ ID NO: 55895 - DNA, 1437 bp, Artificial Sequence
  Description of Artificial Sequence: Synthetic coding sequence
atgtcaggagtgatgtgcttgaaggcttccgacacatgggcaagtggtatcaggtcccagccacagggttgtctcggtaagtggagatccatgcgttgtaagcacacgaggatgcatctggcacatcttggaaatagcagacaactaatttccctggggccacctcgcacgagagaagacggcagccgtatctcacagcaggtcgagcaatctagatcccaagtacaagcaattggagaaaaagtctctctggctcaagccaaaatcgagaaaatcaaaggatcgaagaaagctataaaagtattttcatccgccaaatatccagcacctgagcgcctgcaagaatatggatccatatttacaggagcacaagaccccggtttgcagaggcgccctaggcatcgcatccagtccaaacacagacctcttgacgaacgcgctcttcaagaaaagctgaaagacttccctgtgtgcgtcagtactaaacctgaacccgaggatgacgccgaagagggactgggcggactaccgagtaacatttcttccgtctcctccctcctcttgtttaatactactgaaaatctctacaagaagtacgtctttctagacccgctggccggagcggtgacaaagacccacgtgatgttaggagctgagacggaggagaaactgtttgatgctccgctatcgatttctaagcgtgagcaattagagcaacaggtgccggagaactacttctacgtgcctgacttgggacaggtgccagagatagatgtgcccagctatctccccgatctaccctctatcgcgaacgatctcatgtacagtgccgacttaggtccgggtatcgccccttccgcccctggcactatccctgaactgcctaccttccataccgaggttgccgaacctctgaaagccgaccttcaagacggcgtgcttactcctccccctccgccacccccacctcccccagcccctgaagtgctcgcctccgcaccccctctgccccctagcacggccgctcccgtgggccaaggagctcgccaggacgatggctcgtccagcgccagcccaagcgtgcagggcgcaccgagagaggtggttgaccccagcggtggttgggctactctgttggaatctatacgccaagcaggtggcatcggcaaggccaaacttaggtcaatgaaggagcgaaagctagagaagaagaagcaaaaggaacaggaacaggtacgggctacctcgcagggaggacacttaatgtcagacctgttcaacaaactcgttatgcgtagaaaagggatctccggaaaagggccaggtgcaggcgagggacctggtggtgctttcgccagggtttctgacagcatccctccagtaccccctccgcagcaaccacaggctgaagaagatgaagacgactgggagtcctag

SEQ ID NO: 55896 - DNA, 10581 bp, Artificial Sequence
  Description of Artificial Sequence: Synthetic coding sequence
atgaacatggtgaagagaatcatgggcaggccaaggcaagaggaatgctcaccacaggataacgctctaggattgatgcacctgcgaagattgtttaccgagctttgtcacccgccaagacatatgacacagaaagaacaggaagagaagctgtacatgatgctccccgtctttaatcgggtttttgggaacgcgccaccaaatactatgaccgagaaatttagcgacctgcttcagttcactacccaggtgtcgagattgatggtaacagagattaggcggcgagcatctaacaagtccaccgaagccgctagtagggcaatcgtgcagtttctcgaaatcaaccaaagcgaggaggctagtcgtggatggatgttgcttactacaatcaatctcctcgcttcttctgggcagaagacggtggactgtatgacaaccatgagcgtgccatccactttagtgaagtgtctgtatctgttctttgaccttcctcacgtgccagaggccgttggtggtgcgcagaacgaacttcctctggccgaaaggaggggcctcttgcagaaggtttttgtccaaattctcgtgaaactctgtagttttgtcagccccgctgaggagctggcccagaaggatgacctccagctcctgtttagtgccatcacttcatggtgtcctccttataatctcccttggaggaaaagcgccggtgaggtgttgatgacaatctcaagacatggcctcagcgtgaacgttgtgaagtacatccatgagaaagagtgcttgtctacctgtgttcagaacatgcaacagtctgacgacctatctcctctggagatcgtcgaaatgttcgccggactcagttgcttcctgaaggatagttccgacgtgtcacaaacgcttttggatgatttccgaatttggcagggctataattttctttgcgatctcttgttgcggctggaacaggccaaggaggcagagtcgaaggacgccttgaaagacctcgtaaacttaattacgagtctgactacttatggcgtcagtgagctcaaacccgctggcattactacaggagcaccatttctgctccctggtttcgcggtgccccaacctgccggaaaaggccatagcgtccgaaacgtgcaagcttttgctgtgctacagaatgcgttcctgaaggctaagacatcatttcttgctcagataattctcgacgcaatcaccaatatttatatggccgacaatgccaactacttcatattagagagccaacacaccctctcccaatttgcggaaaagatcagcaaactgccagaggtgcagaacaagtactttgaaatgctagagttcgtggtgttctcgctaaattacattccgtgcaaggaacttatcagcgtgtcaatcctgctgaagtcttcttcaagttaccactgttccattatcgcaatgaagaccctgttaaaattcacgagacacgattacatcttcaaagacgtgttcagagaagttggactgctcgaggtcatggtaaacctactacacaagtacgccgctctgctcaaggatcctactcaggcactgaatgagcagggagacagccgcaacaattcttctgtggaggaccaaaagcatctggccttgttagtgatggagacattgaccgttctcttacagggctcaaacacgaacgcaggtatcttcagagagtttggtggagccagatgcgcccataatattgtgaagtacccccagtgtagacagcacgccctgatgaccatccagcagctcgtcctttccccaaatggcgacgatgacatgggaacgctgctgggcctgatgcatagtgcaccgccaacagagctccaacttaagaccgacattttgagggcactgcttagtgttctgcgggagagccacaggtcaaggaccgtcttcaggaaggtggggggttttgtctacatcacaagcctcctcgtagcaatggagagatcactcagttgccctccaaagaacggatgggagaaggtgaatcagaatcaagtatttgagctcctccatactgtgttttgcaccctgacagccgcaatgcgttacgaacctgccaactctcattttttcaagactgagatccagtacgaaaagctggctgatgccgtcaggttcttgggctgctttagcgatctgagaaaaatctccgccatgaacgtctttccatcgaatacccagccctttcagcgcttgttggaagaggatgtaataagcattgaatcagttagcccaaccctgaggcactgcagtaagttgtttatctacttatacaaagtcgccaccgatagcttcgactcacgagccgagcagattccgccatgcttaacctccgagtccagtcttccgtcaccatggggaaccccagccctgtctcggaagcggcatgcctaccattccgtgtctaccccaccggtgtatcccccaaaaaatgtggcagacttgaaactgcacgtcaccacctcttcgctgcaatcttcggacgccgtgattattcatcctggggctatgttagccatgctggacctgttagcttccgtggggtccgttacacagccagaacacgctctcgacctgcagctagccgtggctaacattcttcagtccttggttcacacagagcgtaaccaacaagtcatgtgtgaggcagggctccacgcacgcttgttacaaagatgcagcgctgcccttgccgacgaagaccattccctgcacccacctctgcagcgcatgtttgagcggttggcatctcaggcactggaacccatggtgttgcgggaattcctgcgattagcaagtcctctgaattgtggggcatgggataaaaagctgttaaaacagtacagagtgcacaagcctagctccttgagttatgagccagaaatgcgttcatctatgattacttcactagaaggactgggcactgataatgtgttcagtctccatgaagataaccactaccgcatctccaaatccctggtgaaaagcgcagaaggatccactgtacctttgacccgtgtgaagtgccttgtgtctatgacgacccctcacgacattcggctccacggtagctctgtgacaccagcgttcgtggagttcgacacctcactcgaggggtttggatgtctttttcttccatctctagcgcctcacaatgccccaacaaataataccgtaacaaccggactaatcgacggggcagtcgtcagcggaattgggtctggtgaaaggttttttcccccacccagtggactgagttactcaagttggttttgtatcgagcacttctcctctccccctaataaccatcccgttcgactgcttacagttgtgaggagagccaacagttctgaacagcactacgtgtgccttgccattgtccttagcgcaaaggacagatctctcatagtgagcacgaaggaagagctattgcagaattacgtcgacgatttctcagaggagagctctttttacgaaatactgccgtgttgtgcaaggttccgttgcggggaactgattatcgaagggcagtggcaccatctggtgcttgttatgagtaaaggcatgctgaagaacagtaccgccgcactgtacattgatggccagctggtcaacactgtgaagttacattacgttcactccacacccggtggcagtggtagcgccaatccccctgttgtgtcgactgtctatgcttatatcgggactcctcctgcccagcgccagattgcatcattagtgtggcggttgggtcccacgcactttctcgaagaggtcttaccctcctcgaacgtgacaaccatttacgagctaggcccaaattatgtaggatcattccaggctgtgtgcatgccatgtaaggacgcaaagagcgagggggtcgtgcctagtcctgtgagtctggtgcctgaagaaaaagtcagttttggcctctacgccctgtccgtcagctcactgactgtcgctagaattcgtaaggtgtacaacaagctggatagcaaagccatcgctaagcagctaggcatcagctcccacgagaatgctactccagtgaagctgatccataattccgcaggccacctcaacggttctgctcggaccattggagctgccttgatcggatacctcggcgtgagaacattcgtacctaaaccggtcgccactacactgcagtacgtcggcggtgccgcagccatacttggcttggtggctatggcctcggacgtggaaggactgtatgcagcagttaaagccctggtctgtgtggttaaaagtaatccgttggcttctaaagagatggaaaggattaaggggtatcagctgctcgctatgctgcttaaaaaaaagcgctccttgctcaattcccacattttacacctgacgtttagcctcgtaggcacagtggatagcggtcacgaaactagtattatacccaattcaactgccttccaagatttgctgtgcgatttcgaggtttggttgcacgccccatacgaactccacctttcgctgttcgaacatttcattgaactgcttacggagagcagtgaggcatcaaagaacgcaaaactgatgcgggagttccaacttattcccaagcttctgctgactctgagggatatgtctctctcacagcctaccatcgctgctatctctaacgttctatctttcctccttcaggggttcccatcctccaatgacctgttgagatttggccagtttattagcagcactctgcccaccttcgctgtatgcgagaaattcgtcgtcatggaaataaataacgaagaaaagctggataccggcactgaagaagaatttggtggcttggtgagcgccaacctgattctgctgcggaatcggctgttagacattctgttgaagctgatttatacatcaaaagaaaagactagcattaacctgcaggcctgtgaagagttagtgaaaacattggggtttgactggatcatgatgttcatggaggaacacttgcattccactaccgtcaccgctgcaatgaggatattagtggtgctcctgtccaaccaatcgattcttatcaagttcaaagagggcctcagcgggggagggtggcttgagcaaacagattccgtcctcactaacaaaattgggacggtactgggcttcaatgtgggtagatctgctgggggaagatccacggtccgagaaatcaatcgcgatgcttgccacttccctgggtttcccgtgctgcagtcctttttgcctaagcataccaacgtgcctgcactctattttttgctgatggcgctcttccttcagcagccagtgtccgagttacccgagaatcttcaagtcagtgtacccgtaatttcctgtcgcagcaagcaagggtgccaattcgatctcgattccatttggaccttcatattcggtgtccctgcatctagcggaacagtcgtgagcagtatccataatgtgtgcaccgaggctgtgttcctgcttctgggcatgttgcgtagtatgctgactagtccctggcagagcgaagaggagggaagttggttgcgggagtatcccgttacactaatgcagttcttcaggtatctctaccacaatgttcctgacctagcctccatgtggatgtcacccgactttctttgtgcattagcagccaccgtctttcctttcaacattagaccctacagtgaaatggtaactgacttggacgatgaggtgggcagcccagctgaggagtttaaggccttcgcagccgacacaggtatgaatagatcgcagtccgagtactgcaatgtgggcaccaaaacttacttgaccaaccacccggctaagaaatttgtgttcgacttcatgcgggtactgatcattgataatctctgtctcacacctgcatccaaacagacacccctgatcgatctccttctggaggcttcccccgaacgcagtacacggacacaacagaaagagttccaaacctatatactagactccgtgatggaccatttgctggccgctgacgttctgctgggagaagacgcgtcactgcctataacctctggcggatcataccaagttttagtcaataacgtgttttacttcacccagcgggttgtcgacaagctgtggcagggtatgttcaataaagaaagtaagctcctaatcgattttatcatccagttaattgcacagtctaagcgtagatctcaggggctgagtctagatgcagtctaccactgcctgaacaggacaatcctctaccagttctccagggctcacaaaactgtgccccagcaagtggccctgctggattccctacgggtgctgaccgtgaatagaaacttgattctggggcctggcaaccatgatcaggaattcatcagttgcctcgcccattgccttatcaatttacatgtgggatccaatgtggacggtttcggcctcgaggcagaggctcgcatgacaacctggcacattatgataccctccgatatcgagccagatggatcatactcccaggatatttctgagggccgacagctgttgattaaggccgttaatcgcgtgtggactgagctgatccacagtaaaaagcaggtgctcgaagagctgtttaaagtgaccttgccagtgaacgaaaggggccatgtggacatcgcaacagcacggcctcttatcgaagaagccgctctgaagtgttggcaaaaccacctagctcacgagaaaaagtgcatctctcggggtgaggcactggcccctactactcagtccaagctgtcccgagtttcctccggattcggtctgtctaagttgactgggtcgagaagaaatcgcaaagagtctggactgaacaagcacagcctgtctacgcaggaaatttcacaatggatgtttacccatattgcggtggtcagggatttagtcgacacgcagtacaaggagtaccaggagcgacagcagaacgcactgaagtatgtcaccgaggagtggtgccagatcgagtgtgaactgctccgggagagagggttgtgggggccacccatcggctcccaccttgataaatggatgctggagatgaccgagggaccttgccggatgagaaagaaaatggtccgcaacgacatgttttacaaccactatccgtacgttcccgagacagagcaggagacgaacgtggcgagcgagatcccctccaagcagcctgagacccctgacgacatccctcaaaaaaagccagcgaggtatcgaagggcagtctcatacgatagtaaagagtattacatgagactggcatccggaaaccctgctatcgttcaggatgccatcgttgagtctagtgagggagaggccgctcagcaggaacctgaacacggagaagatactatcgctaaggtcaagggcttggtgaagccacccttgaaaaggtccaggagtgcacctgatgggggtgacgaagagaatcaagaacagctccaggatcagatcgcagaggggtcatctatagaagaggaggagaagactgataacgctaccttgcttcgcctgctggaggaaggcgaaaaaattcagcacatgtaccgctgtgcccgtgtgcaggggctcgacactagtgagggactgctactcttcggcaaagagcacttttatgttattgatggttttacaatgactgcaaccagagagatcagagacatcgagacgttgccacctaacatgcatgaaccaataattcccaggggcgctagacagggaccctctcagctaaagagaacttgttcaatatttgcttacgaggacattaaagaggtgcacaagagacggtacttactgcaaccaatagctgtggaggttttcagcggcgatggtcggaactatttactcgccttccaaaaagggattcgcaacaaagtgtaccagcgatttctggccgtggtaccgtctctcacagatagcagtgagtcagtgtcaggccagagacccaatacatcagttgaacaggggagtggtctgcttagtacccttgtgggcgagaagagcgtgacacagcgctgggagcgcggtgagatctccaatttccagtacctaatgcatctgaacacactagctggccgtagctacaatgatctcatgcagtacccagtgttcccttggatacttgccgactacgacagtgaagaagtagatctaacaaaccctaagactttccgcaacctggcaaaacctatgggtgctcaaacggatgaaaggctggctcagtacaagaagagatacaaagactgggaggatcccaacggggagacacccgcttatcactatggtacccactacagctctgccatgattgtcgcaagctatctggttcgcatggaacccttcacccagattttcctgaggctgcaggggggacatttcgatctcgcagaccgcatgttccacagcgtcagggaggcatggtactctgcttctaagcacaatatggcagatgtcaaggagctgatcccagagtttttctatttaccagagttcctctttaactccaataactttgatttaggctgcaaacagaatggaacgaagcttggagatgtgatcctgcccccttgggctaaaggtgatcctagggaatttatcagagttcaccgcgaggcacttgagtgtgattacgtgagcgcccacctgcatgaatggatcgacctgatcttcggctataagcaacaggggcctgcagccgtcgaggcggtgaacgtctttcaccatctgttctacgagggccaggtggatatctacaacatcaatgatcccttaaaagagaccgctaccatagggttcataaacaatttcggccagattcctaaacaattatttaagaagccccacccccctaaaagagtgaggtcaagattgaatggagacaacgccggaatttcagtcttaccgggatccacatccgataaaatttttttccaccacctcgataatttgcgcccatcactgacaccagtaaaagaactgaaagagccggttggtcagattgtgtgtacagacaagggcatcttagctgtcgaacagaataaagttctgatcccccctacttggaacaaaacatttgcctggggctacgcagatctttcctgcagactgggtacttatgagtccgataaagcaatgacagtctacgaatgtcttagtgagtggggtcagatcctgtgcgcaatctgtcccaacccgaagctcgtgatcactgggggtacctcaactgtcgtgtgtgtttgggaaatgggaaccagcaaggagaaggctaagacagtgacattgaaacaggccttgctgggacacaccgatacagtaacctgcgccaccgcttctctggcatatcatattattgtatctggatcaagagatcggacttgtatcatctgggacctgaataagctgtcgttcctgacgcagctccggggtcaccgcgcaccagtgtccgcactgtgcataaacgaactcacaggggatatagtgtcgtgtgccggaacttatattcacgtgtggtctattaatggcaatcctatagtaagcgtgaacacttttaccggccgtagccagcagatcatctgttgctgtatgagtgagatgaacgagtgggacacacagaacgttatcgttacaggtcattccgatggcgtagtaagattttggcggatggagtttctgcaagtaccagagacccccgctcctgagcctgccgaggtgctggagatgcaggaggactgtccagaggcccaaatcggccaggaggcacaggacgaggattccagcgattccgaggccgacgaacagagcatctcccaagaccccaaagacacccctagccagccatcctccacatcacataggcccagagcggcatcatgtcgcgcaaccgccgcttggtgcacggatagtggtagtgatgatagcaggcgctggtcagaccagttatcacttgatgagaaggacggattcatcttcgtgaattactccgagggacagactagagctcacctgcagggaccattgtcccatcctcatcccaatcctatcgaagtgaggaactactcaaggctaaaaccgggataccggtgggagcgccagcttgtgttccgcagcaagctgacgatgcacacggcattcgatcggaaggataacgcccaccccgcagaagtcactgctctcgggatatccaaggatcactcgcgaattctggttggagactctcgtggcagagtgttcagttggtccgtttctgaccagcccggacggtctgccgctgaccattgggtgaaggatgagggaggcgactcctgcagcgggtgttccgtccgtttctccttaaccgagcgacgccatcactgccggaactgcgggcagttgttttgccagaagtgcagccgctttcagtcagaaatcaaaaggctcaagatatctagtcctgtccgggtgtgtcagaactgctactataacttacagcacgagcgtgggtccgaagacggccctcgcaattgttaa

SEQ ID NO: 55897 - DNA, 10530 bp, Artificial Sequence
  Description of Artificial Sequence: Synthetic coding sequence
atgaatatggtgaagaggatcatgggtcgccctcggcaggaagagtgctccccacaggacaacgctttgggcctgatgcacctcaggcggcttttcaccgagctctgtcaccctcctcgtcatatgacacagaaggagcaggaagagaaactgtacatgatgctgccggtatttaacagagtatttggtaacgcccctcctaacaccatgacggaaaagttttctgacttgcttcagttcaccacacaggtcagcagactgatggtgacagagattcgtaggagagcatccaacaagagcactgaggcagcctcccgggctatagtccagttcctcgaaattaatcagtccgaggaagcctcccggggatggatgctacttacaactatcaacctgctggctagcagcggccagaaaacagtcgattgtatgactaccatgtcggtcccgtccacactggtgaaatgcctgtacctatttttcgacctcccacatgtgcccgaagctgtcgggggagcacagaatgagctgcccctggccgagcgacggggactgcttcagaaagtgttcgtgcagattctggtgaaactgtgtagcttcgttagtcccgcagaggaactggctcagaaagacgatctacaactgctcttcagcgccatcactagctggtgtccaccttataatcttccatggaggaagtcggctggggaagtgcttatgactattagccgccacggcttgagtgtcaacgtggttaaatacattcacgaaaaggagtgcctgagcacctgcgtgcagaatatgcagcagagtgacgatctttctcccttggagattgtcgagatgtttgctggactgtcatgtttcctgaaggatagctccgatgtttctcaaacactgttggacgactttaggatttggcagggatacaacttcctctgcgacctcttactcaggctcgaacaagccaaggaggctgagtccaaagatgccttgaaggacctagtgaacctgataacatcgctgacaacatacggggtctcggaactaaagccagctggaatcacaacgggagccccattcctgctgccgggatttgccgtgccacagcccgcagggaaagggcacagcgtgcgcaacgtacaagcattcgctgtgcttcaaaacgctttcctgaaggctaagacttcattcctggctcagatcatccttgacgctattaccaatatctatatggcggacaacgcaaactatttcatcttagagtcccaacatacactctcacagttcgctgagaagatctctaaactcccagaggtccagaacaaatacttcgagatgctggagtttgtggtattttccctgaactacatcccttgcaaagagctgatctctgtaagcattttacttaagagttcaagctcttatcactgctcaataatagcaatgaagacccttcttaagttcaccagacatgactacattttcaaggacgtgtttagagaagtcggccttctagaagtgatggtgaatctgctgcataaatacgccgcactgctcaaggatcctacacaggcgctgaatgagcagggagattctagaaacaactcgtctgttgaagaccagaagcacctggctctgctggtgatggagactttgacagtgctgctgcaaggatctaatactaacgccggaatcttcagggagttcggcggtgcaagatgtgctcataacatcgtgaagtaccctcagtgtcgtcagcacgccctaatgacaatccaacaattggtcctgagtcccaacggggatgatgatatgggaacacttctggggctgatgcattcagccccacctactgagttgcagctcaaaacggatattctacgggctctgttgtctgtgctccgagagagtcaccgctccaggactgtcttccgcaaagttggcggttttgtgtacatcacatcacttctggttgccatggaacgctccctgtcttgccccccaaaaaacggttgggaaaaggtgaatcagaaccaagtttttgagttactccacaccgttttctgcacactgacagccgcaatgaggtacgaacccgctaattcccatttttttaagactgagattcagtatgaaaaattggctgacgcggttcgctttctcggctgcttttctgatttaaggaaaatctcagccatgaacgtgttcccaagcaacactcagcctttccagcgactgctggaggaagatgtaatatctatagaatccgtttcccctactttacggcactgtagcaagctttttatatatctatataaggtcgccacagattccttcgatagtagagccgaacagatcccaccttgcttgacctcagagagcagccttcccagcccgtggggaacacccgctctcagtagaaagagacatgcctaccactccgttagtactcccccagtctaccctcctaagaacgttgccgacctcaaactccatgtcacaacaagctctctgcagagctccgatgctgtgatcatccatccaggcgctatgttggccatgttggacctattagcgagcgtaggatccgtcacacagcctgaacacgcactcgatcttcagctggcggttgccaacatcttacaatctttggtgcacacagaacgaaaccagcaggtgatgtgtgaagccggactacatgcaagactgctgcagcggtgtagcgccgctctggccgacgaagatcacagcctgcacccccctctgcaacgtatgtttgagcggctggccagtcaggccctcgagcccatggtcttgcgcgaattcttgcgcctggccagtcccttgaactgtggggcatgggataagaagctgctcaagcagtaccgcgtccataagccctcaagtctgtcttatgagccggagatgcggtcctctatgattactagcttggagggactggggactgacaacgtgttttctctccacgaagataatcactataggattagtaagtccctcgtgaaatccgccgagggtagtacagtcccacttacacgggtgaagtgtctcgtctctatgaccaccccacacgacatcagactgcacgggtcttcagtgacccccgctttcgtagagtttgacacttcccttgaaggctttgggtgtcttttcctgccctcactggccccacacaacgcgcctactaacaacactgtgacaaccggtctgatagatggggcagtggtgtcaggaataggcagtggcgagagattctttccgccacccagtggtctgtcctactcctcctggttttgcattgagcactttagtagtccacctaacaaccatcctgtccgcctgctgacagtcgttcgcagagccaacagctcagaacagcactatgtctgtctggccatcgtcctgagcgcgaaggatcgctctctgatagtgagcaccaaagaagaactcctgcagaactatgttgacgacttcagcgaagagtcctccttctacgagatcctgccttgttgcgccagattccgatgtggcgaacttattattgagggacagtggcatcatctcgtccttgtgatgtcaaagggcatgttgaaaaattcaacagccgcactgtatattgatgggcagctagtgaatactgtgaagctgcattatgtgcattcaacaccagggggaagcggttccgccaatccaccagtggtgtccacggtttatgcttatattggcacccctcccgctcaaaggcagattgcgtcactggtctggaggctgggtcctactcatttcctcgaggaggtgctgccatcctctaacgtgactacgatctacgagctcggccctaattatgtgggatcttttcaggctgtgtgtatgccctgtaaggacgccaaaagtgagggggtagtcccctctcctgtaagcctcgttccagaggaaaaagttagtttcggcctttatgctcttagtgtgtcctctcttactgtggctaggatccgcaaggtttacaacaaattggatagtaaggctatcgcgaagcagctgggcatcagttctcacgagaacgccacaccggtgaagctgattcataacagcgccggacacctgaacggcagcgccagaacaataggcgcagcactgatcggatacctgggggtccgtacgtttgtcccaaagcctgtagcaacgactctgcaatatgtgggaggagcggctgcaatcttgggtctggtggccatggcttctgacgttgagggcctgtacgctgctgtcaaggcactggtgtgcgtggtcaaatcgaaccccctggcctcgaaggagatggagcgtataaagggttaccaattgctggcgatgctgctgaagaaaaagaggtctctgctcaacagtcacatcctgcatcttactttttctctcgtaggcaccgttgatagcggccacgaaactagcatcatccccaattctacagcgtttcaagacttgctgtgtgactttgaagtgtggctgcacgccccttacgagctgcacctcagcctgtttgagcacttcattgagctcctgaccgagagctccgaggcgtctaagaatgccaaactcatgagggagtttcagctgattcctaaactgctcctgaccttgcgagatatgagccttagccagccaaccatagccgcaataagcaacgtcttaagctttcttctccagggcttcccatcatccaatgacctgttacgttttggccagttcatttcaagcaccctgcccacattcgcagtgtgcgagaaattcgttgtcatggagatcaataacgaggaaaaactggacactggaacagaagaagagttcggcggactggtgtccgccaatcttattctgttaagaaatcggcttttagacattttgctgaagctgatctatacctcaaaagaaaagaccagcataaaccttcaggcatgcgaggagctggtgaaaacgctggggtttgattggattatgatgtttatggaggaacatctccattctactaccgtgacagctgccatgcgaatcttggtagtcctactgtcgaatcagtccatccttatcaagtttaaagagggcctgtcaggcggtgggtggcttgaacagacagacagtgtccttactaacaagattggcaccgttctcggcttcaatgtgggacggagcgctgggggtcgttccaccgtccgggagataaacagagatgcctgtcactttcccggattccctgtcttgcagagctttttaccgaaacacaccaatgtccccgcattgtacttcttgctgatggccctgttcctgcagcagcccgtgtcagaactgcctgagaatcttcaggtgagtgtgcccgtgatctcctgcagatctaaacagggatgccagtttgacctcgacagcatatggactttcatctttggtgtccctgcttccagtgggaccgtggtctcaagcatccataacgtgtgcacagaggcagtctttctcctactcggaatgctgagatctatgctcacaagcccctggcagtcagaggaggagggtagctggctgagagagtaccctgttacactgatgcagttctttcggtacctgtaccacaacgtgcctgacttagcctcgatgtggatgtcaccagacttcctgtgcgctctcgctgcaacagtgttcccctttaacatccgaccttattccgagatggtgaccgatttggatgatgaagtggggtctcctgccgaagagtttaaggcctttgctgctgacaccggtatgaatcggtcacaatctgagtactgcaatgtgggcacgaaaacatatcttactaatcaccccgctaagaagttcgtgttcgacttcatgcgcgtgctcattatcgacaacttatgcctgacccctgctagcaaacagaccccactgattgacctgctactagaagcctcaccagaacgctccacccgcacccaacagaaggagttccaaacctacatcctagactcagtcatggaccatctcctcgcagcagacgttctgcttggagaagacgcaagcctccccatcacaagcggcggatcttatcaggtactcgtcaataatgtgttttacttcacccagcgtgtggtggataagctgtggcaggggatgttcaacaaagagagtaagctgttgattgattttattatccagctcatagctcagtccaagagacggtctcagggcttgtctctggatgccgtttaccactgtttgaataggaccatattgtaccagttttcacgagctcacaaaacagtgccccagcaggtggctctcttggattccctgagggtgctgaccgtcaaccggaacttgatcttgggccctggcaaccacgaccaggaattcatctcctgcctggcacattgcctcatcaacctgcacgtcggtagcaatgtggacgggttcgggctggaggccgaggctcgaatgactacttggcatatcatgatcccctcagatatagaacctgacggcagctactcccaagacatttctgaaggcagacagctcctgattaaagctgttaaccgggtgtggacagagctaatacactccaaaaaacaggtgctggaagagttgtttaaggtgaccctgcctgtaaacgaaaggggacacgtggacatcgcaaccgctcggccactcattgaagaggcagcactgaaatgttggcagaaccacctggcccacgaaaaaaagtgcatttctcgcggagaagccttggctccgacaacccagtccaaattgtctcgcgtgtcgagcggtttcggactgtcaaaactcacgggctcgagacggaacaggaaagaatcagggctgaataaacattctcttagcactcaggagatctcacaatggatgttcacacacattgccgtggttagggacctggtggatacacagtataaggagtaccaggaaaggcagcagaacgccttgaaatacgtaacagaggagtggtgtcagattgagtgcgagctgctgagagagcgagggctctggggcccaccaatcggcagccatttggacaaatggatgctcgaaatgaccgagggaccttgtagaatgaggaagaaaatggtccgtaatgatatgttctacaatcattacccctatgtgccagagacagaacaggagaccaatgtggcaaagcctgccaggtacaggagagctgtgtcgtacgactcaaaggagtattatatgcgtctcgcatctggcaaccccgctatcgtgcaggatgccatcgtcgaatcctccgagggggaagcagcccagcaggaaccagagcacggggaggacacgatcgcaaaggtgaagggtctggtgaagccccctctaaaacggagtcgtagtgccccagacggaggtgatgaagagaaccaggagcaattgcaggaccagatagctgaaggttcatctattgaagaggaggaaaagacagataatgccacgcttttgcgacttctcgaggagggagagaaaatacagcatatgtatagatgcgcgcgagtacagggcctcgacacgagcgaaggcctcctcctattcggcaaggaacatttttatgtcatagacggttttaccatgacggccaccagagagatcagagacatcgagactttgccccctaatatgcatgagccgattattccgcgaggagcacggcagggaccctctcagttgaagcggacctgtagtatttttgcatatgaagacattaaggaagtgcataaaagaaggtatctcttgcaacctattgctgtggaagttttttcaggagatggtagaaactaccttctggcattccagaaaggaatccggaacaaagtgtatcagagatttctggcagtggtgcctagtttgacagactcgtctgaatctgtcagcggccagcggccaaacacctctgtggaacaaggtagcggactcctcagcacactggtaggagagaaaagcgtgacccagagatgggagcgcggagagatatccaatttccagtatctgatgcatctgaatactctggctggcaggagctataatgatctgatgcaatatccagtgtttccctggattctggccgactacgactcagaggaggttgatctgacaaaccccaaaacattccgcaatctggctaaacccatgggcgcacagaccgatgagcgcctggcacaatacaaaaagagatataaggactgggaagacccgaacggggaaaccccagcctaccactatggaacccattatagttcagccatgattgtagcctcgtacctggtcaggatggagccatttacccagatattcctgcggcttcaggggggacattttgacctggccgacaggatgttccactccgtccgcgaggcctggtattctgcgagtaagcacaacatggccgacgttaaagagctcattccagaattcttttaccttccggaattcctgtttaattcgaacaactttgacctcggatgtaaacagaacggaaccaagctcggcgatgtgatcctgcctccttgggccaaaggggatccacgcgaattcatccgggtgcatcgggaggctcttgaatgcgattatgtcagcgcccacctgcatgaatggattgacttgatttttggatacaaacagcaagggcctgccgcagtcgaggcggtgaatgtttttcaccacttattctatgaaggacaggtggacatttacaacattaatgaccctctcaaagaaactgccaccataggatttataaataatttcggacaaatacctaagcagctctttaagaaaccccatcccccaaaacgggtcagatctcgtctcaacggcgacaacgcgggtatttctgtgttgcccggatccacctcagataagatattctttcaccacctggacaatcttaggcctagccttactcccgtgaaggagcttaaagagcccgtgggccagattgtttgtaccgacaaaggtattctcgctgtggaacagaataaggttctgataccaccaacgtggaataaaacctttgcctggggatatgcggatctctcatgtcggcttggaacctacgagagcgacaaagcgatgacagtctacgagtgcctgtcagagtggggccagattctgtgtgcaatatgcccaaatcctaagctagtgatcacagggggaactagcactgtggtgtgtgtctgggagatgggaactagcaaggagaaggctaaaacggttacactcaagcaagcccttcttggacataccgacaccgttacatgtgcaacggcatcactggcctatcacataattgttagcggatccagagaccgtacttgcattatctgggacctcaataaactgtccttcctcactcaactccgtgggcaccgggctccagtttccgccctgtgcattaacgagttaaccggtgacattgtgagctgtgcaggtacttacattcacgtatggtcaatcaatggtaaccccatcgtctccgtcaacacatttaccggtcgctcccaacaaattatctgctgttgcatgtccgagatgaatgaatgggacacacagaatgtgattgtgacaggacattctgacggcgtggttagattctggagaatggagttcctacaggttcctgaaacacctgcccctgagcctgccgaggttctggaaatgcaggaggactgtccagaagctcagattggtcaagaagcccaggacgaggatagcagcgactccgaagcggacgagcagtctatatcccaagacccaaaagacacgcctagtcagccgagttccacgtctcatcgaccgcgagctgcatcctgtagggccactgctgcctggtgcaccgatagcgggtctgacgattcccgcagatggtccgatcagctgagtcttgatgagaaggatgggttcatttttgtgaactacagcgaagggcaaacccgagcacatctccagggtcctctgtcccatccccacccaaacccaatcgaggtgaggaattacagcagacttaagcccggatatcgctgggaacgccagctcgtgttcaggagcaagctcacgatgcacactgccttcgacaggaaagataacgcccacccagcagaggtcacggcccttggcatttccaaagaccactctcggattctggtcggagactcgagaggtcgagtattctcttggtcagttagtgatcaaccaggcagatccgcagctgaccactgggttaaagacgagggtggcgatagttgtagcggctgttcagtgaggttttccctgaccgaacggaggcaccattgccgcaattgtggccagctgttctgccaaaagtgcagcaggtttcagtccgagatcaagcggctgaagatttcaagcccggtccgcgtctgccagaattgctactacaatctccagcacgaacgcggtagtgaggatggccctcggaactgctat

SEQ ID NO: 55898 - DNA, 30 bp, Artificial Sequence
  Description of Artificial Sequence: Synthetic coding sequence
atgaatatggttaagcggattatgggatag

SEQ ID NO: 55899 - DNA, 183 bp, Artificial Sequence
  Description of Artificial Sequence: Synthetic coding sequence
atgaatatggtcaagcgtattatgggccgacctagacaggaagagtgcagtccacaagataatgccctgggcctgatgcacctgcggagactatttaccgaactgtgtcacccccctcgacacatgactcagaaggagcaagaagagaagttgtatatgatgcttcccgtgttcaaccgatag

SEQ ID NO: 55900 - DNA, 2241 bp, Artificial Sequence
  Description of Artificial Sequence: Synthetic coding sequence
atgcgcagggagttctgttgggatgcctattctaaggcagccggaagcagggctagcagtccacttccacgacaggacagagatagcttctgccatcagatgtctttttgtctgacagagctacatctctggtcgctcaaaaatactctgcatatcgcagaccgagacattggaatctaccagtattatgacaaaaaagaccctcccgctactgagcacggcaacctggaaaaaaaacagaagctggctgaatccagagactacccttggaccctgaagaatcggaggcccgaaaaactcagagattcactcaaggagctggaagagctcatgcaaaacagccgctgtgtcctgagcaagtggaagaataagtacgtgtgtcagctgctgttcggatccggagttctggtgtcactgtcactgtctgggccacagctggagaaagtcgtgattgacagatctttggtgggaaagctcatctctgacactatatcagacgctttgctgaccgactcttttataattctctcttttctggcacagaataagctgtgtttcatccagtttaccaaaaagatggaatcctccgacgtaaataaacgcttggagaaattgagcgcactcgattataagattttctactacgaaattcctgggccaatcaacaaaaccactgagcggcatctggctataaactgtgtacacgaccgggtagtgtgttggtggccacttgtcaatgacgacgcctggccttgggcaccaatctctagtgagaaggaccgggcaaacttgttgctgttaggctacgcccaaggccgtttagaagtgctctctagcgtgcggactgaatgggatcccctcgacgtgcggtttgggacaaagcagccgtatcaagtcttcacagtcgaacattccgtgtccgtggacaaggagcccatggccgactcatgtatttacgagtgtatcaggaataaaattcagtgcgtatctgttactaggatcccactgaaaagcaaggccatcagttgctgccggaacgtcaccgaggacaagctgatcttgggatgcgaggacagctccctaatactgtacgagactcatcgccgtgtcacccttttggcccagaccgagttgctgccctccttgatcagctgtcacccgtctggcgcaattctgctggtcggcagcaatcagggtgagctccaaattttcgatatggctttatccccaatcaacatccagctactcgcagaagaccggctgccacgcgagacgcttcagtttagcaagcttttcgacgcctcttctagtctcgtgcagatgcagtggattgcccctcaggtcgtgtctcagaaaggcgaaggatcagatatttacgacctcctttttctgcggttcgaaagagggcctcttggagtcttgttattcaagctaggtgttttcacgcgcggtcagcttggtctcattgatatcatttttcagtacatccattgtgatgaaatctacgaagctattaacatactgtccagtatgaactgggacacgctgggccatcagtgctttatctcaatgtctgctatcgtgaaccatctcctgagacagaaattgacacctgagagagaggcacagttggaaactagtctaggtacattctatgcccctacccgtccccttctcgattctacaattttagaataccgagaccaaattagtaagtatgctaggcgtttttttcatcatctcctgcggtatcagcgatttgaaaaagctttcctgctcgctgtagacgtgggagcgagagatttatttatggacatccattatttagcactggacaaaggcgaattggcactggctgaggttgctagaaagcgggcaagtgacatcgacgccgaatctattacttcgggggttgagttgctgggccctctggataggggcgacatgctaaacgaggctttcatcggcttatccttggcccctcagggcgaagacagtttccctgacaatttgccgcctagctgtcccacccacaggcatattctgcagcagcgaatactgaacgggtcttccaacagacagattatcgacagaagaaatgagctggaaaaggatatctgttccggtttccttatgaccaacacgtgcaacgctgaagatggtgagttgagggaggacggcagagaacaggaaattagagacgggggatccttgaagatgattcattttggactcgtgtag

SEQ ID NO: 55901 - DNA, 2742 bp, Artificial Sequence
  Description of Artificial Sequence: Synthetic coding sequence
atggccagtgagtctgatacggaggaattctatgacgcacccgaggacgttcaccttggcggagggtaccccgtaggtagtcccggtaaggtagggctgtcaacgttcaaagagaccgagaatacagcgtataaggttgggaacgaatctcccgttcaagagctaaaacaggacgtgagcaaaaaaatcattgagtctatcatcgaagaaagtcagaaggtgctgcagctcgaggatgattcactggatagcaaaggcaaagaattgagtgaccaggctactgcttctccaatagttgccaggacggacctatccaacatcccaggccttcttgccattgatcaggtgcttcctgaggaatcccagaaggccgagtctcagaacacctttgaggagaccgaactggaactgaagaaatgttttccaagcgacgagacgtgcgagaagcctgtcgacgaaacgacaaagctgacccagacatcatctacagagcaacttaatgtgctggagacagaaacagaagtactcaataaagaagccgtagaggtaaaaggcggtggagacgtcctggagccagtgagcagcgacagcctgtccacaaaagattttgctgccgttgaagaggtggctcccgcaaagccacccagacatctcactcccgaaccggacattgtcgcatccactaaaaagccagtacctgctcgaccaccccctcccacaaatttccctccaccccgtccgcctccgcctagtcgacctgcccctccccctagaaaaaggaaatcagagcttgaattcgagaccctgaagacccccgacatcgacgttcccaaagaaaatatcacatccgacagtctgttaactgccagcatggctagcgagtcaacggtgaaagactcacagccatctctggacctggcttcagctacttctggggataagatcgtcactgcacaggagaatggcaaggcacccgatggccagaccgtggctggcgaggtgatgggccctcagcggccaagatcaaattccggaagggagttgaccgacgaagagatacttgcaagtgtgatgatcaagaatctagataccggagaggaaatcccactgagccttgctgaggaaaagctgcctactggcattaatccattgacactgcacattatgcgcagaacaaaagagtacgtatctaacgatgccgcacaatccgacgacgaggaaaagctccagagtcagcctaccgacactgacggaggccgactgaaacaaaaaacaacacagcttaaaaagtttctgggaaaatcagtgaagcgggcaaaacatttggctgaggagtacggcgaacgtgccatcaataaagtgaaatccgtccgggacgaggtttttcatacagatcaggacgatcctagcagttcagacgacgaaggcatgccctatacacgcccagttaaatttaaggccgctcatgggtttaaggggccatatgatttcgatcagattaaagtggtacaggaccttagcggagaacacatgggtgccgtatggacaatgaaattctcccactgtggccgacttctcgcatccgccggtcaggataacgtcgtcagaatttgggcgttaaagaatgctttcgattattttaataatatgcgcatgaaatataacacagagggcagagttagtccatccccgtctcaggagagcctgtcttcttcgaaatccgatacagacacaggggtgtgtagtggaacagatgaggatccggacgataaaaatgcacccttccggcagaggcccttttgtaaatacaaaggtcacaccgcggacctgctagatctgagttggagcaaaaattactttcttctgtcctcttcaatggacaagactgtgagattgtggcatatcagccggcgagagtgcttgtgctgcttccaacacatcgatttcgtcacagcgatcgcattccaccctcgtgatgaccgctacttcctaagcgggtcgctggatgggaaactgcgtttgtggaacatccctgacaagaaagtagccctctggaatgaagtagacggtcagacaaaactcattacagctgccaatttttgccagaacgggaaatacgcagttatcggtacctatgatggcaggtgtattttctacgacaccgaacatctaaaataccatacccagatccacgtccggagtacaagggggcgaaataaagttgggcgtaaaatcaccggcatcgagcctctgcccggtgagaataagatcctggtgacttccaatgattcacggatcaggttgtacgatctgcgggaccttagcttgagtatgaaatataaaggctatgttaacagctcatcgcagataaaggcgtcattctcgcatgacttcacataccttgtgtcagggtcagaagataagtatgtgtacatttggtccacataccacgatctctctaaattcacctccgtcaggcgggaccgcaacgacttctgggagggcattaaggctcacaatgccgtggtaacctctgccatcttcgcccctaatccatccttaatgctatctcttgatgtgcagtctgagaaatccgagggaaacgaaaagtcagaggatgcagaggtgcttgacgcgacccctagcggtatcatgaagactgataacacggaggtgctgctcagcgccgacttcaccggggctatcaaagtctttgtgaataaaaggaagaacgtgtcatag

SEQ ID NO: 55902 - DNA, 867 bp, Artificial Sequence
  Description of Artificial Sequence: Synthetic coding sequence
tggggtaaaaattactttctgctgtcttcttccatggacaagaccgtgagattgtggcacatttctaggagggaatgcctgtgttgcttccaacatatagattttgttaccgctatcgcattccatccccgtgacgaccgatacttcctgtccggatcgctggatggaaaattaaggctctggaacatccccgataaaaaagttgcactgtggaatgaagttgacggacagacgaagctcatcacagctgcaaatttttgccagaatggaaagtacgctgtgatcggcacctatgatggacgctgcatcttctatgatacagaacatctgaagtatcatacgcagatccacgtgaggagcaccagagggaggaataaagttgggagaaagattactggaattgaaccccttccaggggagaacaagatacttgtcaccagcaacgattctcggatcagattgtatgaccttcgggacctttctctctccatgaaatacaaaggctacgtcaattcgagtagccagatcaaagcatcattttcccacgattttacttacctggtgtctggcagcgaggacaaatacgtatacatttggagcacctaccacgacctgagtaagtttacatccgtaagacgcgatcgaaatgatttctgggaagggataaaagcccacaatgcggttgtgacctctgcgatcttcgcacctaaccccagtttgatgctgtctctggatgtgcagtctgaaaagtccgaggggaacgagaagtccgaggacgctgaggttttggatgccactccgtccggcgcagtagcacatgcatgcaaccccagtactttgggcggtaggggccgtaggatcacttag

SEQ ID NO: 55903 - DNA, 2475 bp, Artificial Sequence
  Description of Artificial Sequence: Synthetic coding sequence
atggcgtcggagagtgatacggaggagttctatgacgctcccgaggatgtgcacctcgggggtggctaccctgtgggcagcccgggtaaggtgggactgtccacatttaaaatcatcgagtcgataatcgaggaaagccaaaaggtgttgcaactggaagacgacagtcttgattccaaaggaaaagagctgtccgaccaggccacggcttctcccattgtggcgcgtacagatttgagcaacatacctggactccttgcaatcgaccaggtgttgccggaggaatctcaaaaggctgagagtcagaacaccttcgaggaaaccgagctcgagctaaaaaagtgcttcccctcagacgagacctgcgagaagcctgttgacgaaactaccaagttaacacaaactagctctacagagcaattgaatgtccttgaaacggagacagaggtgttgaataaagaagctgtggaagtgaaaggcggaggagatgtgctcgaacctgtttcctccgatagtctgagcacaaaagatttcgctgccgtcgaagaggtggccccagccaagcccccacggcatcttacaccggagcctgatatcgttgcttcaaccaagaagcctgttcccgcacgacccccacctccaacgaatttcccgcctccccgtccaccgccacctagcaggcccgcaccccctcccaggaaacggaaatctgaattagaattcgagacccttaagacgccggacatcgatgtgcccaaggaaaacataacaagcgactctctgctgaccgcgtccatggcttctgagagtaccgtgaaggactcccagccctccctagatctcgccagcgcaacatcaggagacaaaatcgtcactgctcaagaaaatggcaaggcacctgatggacaaactgtggccggtgaagttatgggaccccagcggcctcgatccaactctgggcgagaactgactgatgaagagattcttgcctccgttatgatcaagaacctcgatacaggggaagaaatccctttgagtctggctgaggaaaaacttcctaccggaattaatcctctgaccctgcacattatgcgtagaaccaaggagtacgtctccaatgacgccgcacagtccgacgacgaagaaaaacttcagtcccagcctacggatacagatgggggtaggctgaaacagaagacgacgcagttgaagaaatttctgggcaagtcagtgaaacgggcaaagcatttagcagaggaatacggagagcgagccataaataaagtaaaatccgtcagggatgaggtctttcacacggaccaggatgatcccagctcatccgatgatgaagggatgccttatactaggcccgtgaaatttaaggcagcacacggttttaaaggcccatacgactttgatcagatcaaggtggttcaggatctttccggtgagcacatgggtgctgtctggacgatgaagttctcccattgtggacggctgcttgccagtgctggccaggacaacgtagttcggatctgggctcttaaaaacgcctttgattacttcaacaacatgcggatgaaatataacaccgagggcagggtgagtccaagcccatcacaggagtccctgtcctcgtccaaatccgacacagacacaggggtgtgctcgggaacagacgaagatccggacgataaaaatgcacccttcaggcagaggcctttttgtaagtataagggccatacggccgacctgctggacttatcctggtccaagaattatttcttgctctcgtccagcatggataagaccgtgaggttatggcacataagccgaagggagtgcctgtgctgcttccagcacatcgactttgtgactgccatcgccttccaccccaggcatctcaagtaccatacacaaatccacgttcgcagcacacggggaagaaataaagtcggacggaaaattactggaatcgagcccttgccaggagagaataagatcttagtaaccagcaatgactcccgaatccggttgtacgacttgcgagatctttccctttccatgaagtataagggctacgtaaacagcagttctcaaattaaagccagcttttcccatgattttacttatctggtttctgggtctgaggacaagtacgtgtacatctggtctacctaccacgatctgtccaaatttacctccgtgcgcagggaccgtaacgacttttgggaaggaatcaaagctcacaatgcagttgtcacctccgccatttttgccccaaacccatctctcatgttgagcttggacgtccaaagcgaaaaaagtgagggaaatgagaaatccgaagatgccgaggtccttgacgcaacaccctcaggaatcatgaaaactgacaacactgaggtcctactctcagcagacttcactggcgctattaaggttttcgtgaataagcgcaaaaacgtgtcctag

SEQ ID NO: 55904 - DNA, 2718 bp, Artificial Sequence
  Description of Artificial Sequence: Synthetic coding sequence
atggcctcggagtcagacactgaggagttttatgacgcccctgaggatgtccacttagggggaggttaccccgtcggaagtcctggcaaggttggcctgtccactttcaaagagaccgaaaacactgcatacaaagtaggcaatgagagtccagttcaggagcttaagcaggatgtaagcaaaaaaattatagagtccattatcgaagagagtcaaaaagtgctgcagctggaggacgactccctggactctaaagggaaagagctgtcagatcaggccacggcgagcccaattgtcgcaaggactgacctgagtaatatacccggactgttggcaattgaccaggtcctcccggaggaatcccagaaggcagaatctcagaatacctttgaggagaccgaattagaactgaaaaagtgcttcccctccgacgagacatgcgagaagccggtggacgaaaccaccaagctcacacagacatcttccactgagcagttgaatgtactggagaccgaaacagaggtgctgaacaaggaggcagtcgaggtgaaaggcggaggcgacgttttagaaccagtttcaagcgattcactgagcaccaaagatttcgctgccgtagaggaagtggctcctgctaagccccctcgtcatctgactccggagccagatattgtggcgtcaacaaagaaacctgtacctgccagacccccacctcctactaattttcctccacctaggcccccaccaccgagtcgcccagcacccccaccccgaaaacgcaaatctgaattggaattcgaaacactgaagacgcctgatatcgatgtccctaaagaaaacataacgagcgactccctgctgacagcatctatggcttcagagagcactgtaaaagattctcagccttctttagacttggcttctgctacatccggcgacaagattgtcaccgcccaagaaaacggcaaagcacccgacggtcagaccgtggccggtgaggtgatgggaccacagcggcctaggagcaacagtggcagagagctgacagacgaagaaatactcgccagcgttatgattaagaatttagacaccggtgaggagatccccctaagtctggctgaggagaagctgcctacagggattaatccactaacccttcacattatgcggaggactaaggagtatgtttctaatgatgcagcccagtccgatgatgaggagaaattacaaagccagccgaccgataccgacgggggacgtttgaagcagaagacgacacaactgaagaagtttcttggcaagtctgtcaagagggcaaaacaccttgcagaggagtacggcgagcgcgcaataaataaggtgaagagtgtgcgggatgaggtctttcacactgaccaagacgatcctagtagcagcgacgatgagggcatgccctatactcgccctgtgaagttcaaggctgcacacggtttcaaaggaccatacgacttcgatcagattaaagtggtccaagacctgagcggagaacacatgggggcagtgtggacaatgaaatttagccactgcgggagactgctggctagcgcgggtcaggacaatgtggtgcggatctgggccctaaagaacgcgttcgactatttcaacaatatgaggatgaaatataatacagaaggcagagtctccccgagtccttcccaggaatcactttcctccagtaagagtgatactgatactggagtgtgctctgggaccgacgaagaccctgacgacaaaaacgcacctttcagacagaggcctttctgcaaatacaagggccacaccgccgatctcctggacctcagctggagcaagaattattttcttttgtcgtccagcatggataaaaccgtgagattgtggcatattagccgcagggaatgtctctgctgcttccagcacatcgatttcgtgactgctatcgcttttcacccacgcgacgatcgctactttctgagcggctcgctagatggtaaactcaggctgtggaatatcccggataagaaggttgctctgtggaatgaagtagacggccagaccaaactgatcacggctgccaacttctgccagaatggaaaatacgccgtaattgggacatatgacggacgctgcatcttctacgatactgagcatctcaaatatcacacccagatacacgtccgcagcacacggggaaggaataaagtgggcagaaagatcaccggcattgaacctctgccgggagaaaacaagatactggtcacatctaacgactctcggatccggttgtatgatctccgtgacctgtccctctctatgaaatacaagggctatgtgaactcatcatcccagattaaggcctctttcagtggctcggaagataaatatgtgtatatttggagtacatatcatgatctctctaaattcacatcggtgaggcgggaccgcaatgacttttgggagggcataaaagcacacaacgcagtggtgacatcggccatcttcgcacctaatccaagtctgatgctgagcctagatgttcagtccgaaaaaagtgagggtaacgaaaagtcggaggatgctgaggttctggacgccactccttctggcatcatgaagacagacaatacagaagtgctcttgtctgcggattttaccggagcaatcaaagttttcgttaacaaacgaaagaatgttagctag

SEQ ID NO: 55905 - DNA, 2421 bp, Artificial Sequence
  Description of Artificial Sequence: Synthetic coding sequence
tagacagatctgagtaatattcccggactgctggcgatcgaccaagtgctccccgaagagtcccagaaggcagaaagtcagaataccttcgaggagactgaactcgagctgaaaaagtgcttcccatctgatgagacctgcgaaaagccagtggatgagaccacaaagctgactcagactagctcaaccgaacaactgaacgtgctggagacagagacggaggtcttgaacaaagaggcagtggaagtgaagggtggcggagacgtgctggagccggtgtcctctgattccctgagcacaaaagactttgccgcagttgaagaagtcgcccctgcaaagccgccacgccatctgacaccggagccagatatcgtggcctccaccaagaaaccagtgcctgctcggcctccgcctccaactaacttccctccacccaggcccccaccgccatcacgaccagccccacctccccgaaagcggaagtctgagctggaatttgaaacgctcaagactcccgacatcgatgtgccaaaagagaatattacttccgatagtctgctgaccgcgagcatggcatccgaaagtacagtgaaagattcacaacccagccttgatctcgcaagcgcaacaagtggcgataagatcgtgacggcccaggaaaatggcaaggccccagacggacaaactgttgccggtgaggtgatgggcccacagcgtcctaggtcaaattcagggcgagagttgaccgatgaggaaattctcgcatctgtgatgattaaaaatctcgatacaggagaggaaatccctctcagtctggctgaggaaaagctacccaccggcatcaaccctttgacattgcacataatgcggcgtactaaggaatatgtgagcaacgacgccgctcagagtgatgacgaggagaagctccagtcccagccaaccgatactgacggtggaagactcaagcaaaagaccacccagctgaagaagttcctgggcaagtctgttaagcgcgctaagcacttagccgaagaatatggtgaaagggccataaacaaagtgaagtcagtgcgggatgaggtgtttcataccgatcaggacgacccctcttcctccgatgatgagggaatgccttacaccaggccagtcaagtttaaggccgcacacggtttcaaaggtccatatgatttcgaccagattaaggtggtacaagaccttagcggcgagcacatgggggctgtgtggaccatgaaattcagtcactgcggtagacttctggcatccgccggacaggacaatgttgtgagaatttgggccctaaaaaatgcctttgactacttcaataacatgcgaatgaagtataatacggagggcagagtcagcccaagcccgagccaggaatccttatctagcagcaaaagtgataccgacaccggagtgtgttctggcacagatgaggaccctgacgataagaatgccccttttcggcagcggccattctgcaagtataaaggtcacaccgcagatttgcttgatctgtcttggtccaaaaactattttctcctgagctccagtatggacaaaactgtgcgcctgtggcacatttcccgcagagagtgcctatgctgttttcagcacatcgacttcgtcaccgcaatcgcatttcaccctcgcgatgatcgctacttcctaagtggcagtttggacgggaagctgaggctgtggaacatccctgacaaaaaggtcgccttatggaatgaggtggacggtcagactaaactaataaccgctgcaaacttttgtcagaatggaaagtatgccgtgatcggaacgtatgacgggaggtgtatcttctacgacactgagcacctgaagtaccacacccagattcacgtgcgaagcacgcggggtcgcaacaaagttgggagaaagattactggtatagagccactgccaggcgaaaataaaatcctcgtaaccagtaacgatagtcgaatccggctttacgatctgagggacctttctctgtcaatgaagtataaaggatacgttaattccagctcccagatcaaggcgagttttagtcacgacttcacctatctggtctcgggttcggaagacaagtatgtctacatctggtcaacttaccatgatctgtctaagtttacaagtgttagacgggatagaaacgacttttgggagggtatcaaggcccataacgccgtggtaacttctgccatttttgcgccaaatccctcacttatgttatcgctagacgtccagtctgagaagtctgagggcaacgagaaatccgaggacgctgaggtcctggacgcaaccccttcagctatgtcatctaggtacgtcgcccaagctgggctggagctgcttgcttcaaagcggtactacgaagatagatag

SEQ ID NO: 55906 - DNA, 1116 bp, Artificial Sequence
  Description of Artificial Sequence: Synthetic coding sequence
atgacccaacagcccctacgcggtgtcacatccttgagattcaaccaagatcagtcatgcttttgttgtgcaatggaaaccggggtccggatctataacgtggagcctctgatggagaaaggccacctggatcatgagcaagtcggctcaatggggctggtggagatgctgcaccgcagtaacctgttggcgctcgtgggcggaggctctagtcccaagttcagtgagatcagcgtattgatatgggacgatgccagggagggaaaggattccaaggagaaactcgtcttagagtttaccttcacaaaaccagtgctgagcgtgcgaatgaggcacgataagatcgtgatcgtacttaaaaataggatttatgtgtatagttttccagataatcctcggaagctgttcgaatttgatacccgagataatccaaaggccgcacaccctacacctcatctccacaccctgggtctttgcgacctctgtccctcgctggaaaagcagctgctggtgttcccaggacacaaatgtggctcactgcaacttgttgacctggcctcgacaaaacctgggacgtcttccgccccattcaccatcaatgcgcatcaaagcgacatagcctgtgtatcccttaatcaacctggtactgtcgtcgcttcagcgtcacaaaaaggaacactgatacgcttatttgatactcagagcaaagaaaaactggtggagctccgccgaggcacagatcccgcaacgctctattgcattaatttttcccatgattccagcttcctctgcgcctcatccgataagggtactgtgcacatattcgcgttgaaagatacacgcctgaataggagaagtgctctagctcgggtgggaaaggtaggcccaatgatcgggcagtatgtggacagtcaatggtcactggccagctttaccgtgcctgctgaaagcgcttgtatctgcgccttcggaaggaacacctcgaaaaacgtgaatagcgtgatcgccatctgcgtcgatgggacctttcataagtacgtttttactcctgacggcaactgtaaccgggaggcgtttgatgtgtacctcgacatctgcgacgacgatgatttctag

SEQ ID NO: 55907 - DNA, 1086 bp, Artificial Sequence
  Description of Artificial Sequence: Synthetic coding sequence
atgacacaacaacctctgagaggggttacttctctgcggttcaaccaggaccagtcttgcttctgctgcgccatggaaaccggagtgaggatctacaacgtcgaaccgctgatggagaaaggacacctggaccatgaacaggtgggctctatgggcctggtagagatgctccacaggtccaatttgctggcactggttggcggaggtagtagccccaaatttagcgagattagtgcagtgctgatctgggacgatgcacgtgagggcaaggattctaaagagaaactggtgctggaattcactttcacaaagcccgtactgtctgttagaatgaggcatgacaaaattgtgatcgtgctgaaaaaccgcatatacgtgtacagcttccccgataatccaaggaaactgttcgagttcgatacacgggacaaccccaaagggctctgtgatctatgtccttcgctggaaaagcaactgcttgtcttcccagggcataagtgtgggtctctccagcttgtcgacctcgccagtaccaaacctggtacaagcagcgctccttttactatcaatgctcaccagagcgatatagcttgtgtctcccttaaccagccgggaaccgttgtagcctctgcttcccagaaaggaacattaatcaggctatttgacacgcagtccaaggaaaagttagttgaactgagaagaggcaccgaccctgcaaccctgtactgtatcaatttttctcacgactcttcctttctgtgtgccagctccgataagggcactgtgcacatttttgccttgaaagacacccgcctcaaccggaggtccgcactggccagggtgggaaaagtgggccctatgattggtcagtacgttgattcccagtggagtctggcctcctttactgtgccggctgagtccgcctgtatttgcgcatttggcaggaatacctcaaaaaatgtgaactctgttatcgcgatctgcgtggacggaacattccacaaatacgttttcactcccgacgggaactgtaaccgagaagcgtttgacgtgtatttggatatctgcgacgatgacgatttttag

SEQ ID NO: 55908 - DNA, 1086 bp, Artificial Sequence
  Description of Artificial Sequence: Synthetic coding sequence
atgacacaacaacccctccggggagtgacgtccctccgcttcaatcaggatcagagctgcttttgctgcgccatggagactggtgttcggatctacaacgtggaacctctgatggagaaaggccatctggaccatgaacaggtgggatccatgggacttgtcgagatgttacatagatctaatttactggcactggtgggcggtggcagcagtccaaaattctcagagataagcgctgtcctcatttgggacgatgcccgtgagggaaaagacagcaaggagaaactcgtcctcgagttcaccttcactaaaccagtactaagtgtgaggatgcgccatgataaaattgtaatagtgttgaagaaccgcatttacgtatattcattcccagataatcccaggaagctgtttgaatttgacacaagggacaatcctaagggattgtgcgacctctgcccctctctggagaaacagctgttggttttcccaggtcacaaatgcggatcccttcaactggtcgaccttgcaagtactaagcccggtacgagttcagccccatttaccataaacgcacaccaaagcgacattgcctgtgtgtccctgaatcagccgggtacagtggttgcttcagcaagccaaaagggtacattaatccggcttttcgatacacaatcgaaagaaaaactggtggaactacgcagaggcacagacccagctacgttatattgtatcaatttttcccacgattcttcgtttctctgcgcgtctagcgacaagggcaccgttcatatcttcgccctgaaggatacaagattaaaccggcgaagcgcactggccagggtaggcaaagtcggtcccatgattgggcagtatgtggattcccagtggtcgttggccagtttcaccgtgccagctgagtctgcttgtatctgtgctttcgggaggaatactagcaagaatgtcaatagcgtcatcgcaatttgcgtggacgggacctttcacaaatatgttttcacacccgacggtaattgcaaccgggaagcatttgatgtctacttggacatttgtgacgacgacgatttctag

SEQ ID NO: 55909 - DNA, 1083 bp, Artificial Sequence
  Description of Artificial Sequence: Synthetic coding sequence
atgactcagcagcctctccggggtgtcactagcttgcgtttcaaccaggatcagagctgcttctgttgtgcgatggagacgggtgtgcggatctacaatgtcgagcccctcatggaaaagggccatctggatcacgagcaggtgggctctatgggactggttgagatgctccataggtccaatctcttggcgcttgtcggcggagggtcctcccccaaattcagtgaaatttccgtactcatctgggacgatgctcgcgagggtaaggactctaaggagaaactcgtgcttgaatttacttttaccaagcctgtgttgtccgtgcggatgcggcacgataagattgtgattgtgctgaagaaccggatttatgtttactcatttcctgacaatcccaggaagctgtttgaattcgacaccagggataaccccaaagggctgtgcgacctgtgtcccagcttggagaagcagttacttgtctttcctggacacaaatgcggaagtctgcagctcgtggaccttgcttccacgaaaccgggaactagcagcgccccttttaccataaacgcacatcagagcgacattgcctgtgtcagcctgaaccagccgggaaccgtggtcgccagcgccagccaaaaaggaacattaatcagattgtttgacacccagtcaaaggagaaactggtggaactccgcagaggcacggatccagcaacactctattgcataaacttttcccacgacagctcatttttgtgcgcgagttctgacaaggggaccgtgcatatctttgcactcaaagacactcgactcaaccgacgttctgccctggccagagtgggtaaagtgggtcccatgattggacagtacgtggactctcagtggagcttggcatctttcacagtgcctgcagagagtgcctgcatttgtgcatttggaagaaacacttcaaagaacgttaattctgtaattgctatatgcgtcgacggaacctttcataaatacgtgtttacccctgacgggaattgcaacagggaggcatttgacgtctacttggacatatgcgatgatgatgatttttag

SEQ ID NO: 55910 - DNA, 168 bp, Artificial Sequence
  Description of Artificial Sequence: Synthetic coding sequence
atgactcagcagccacttcggggtgttacgagtctgagatttaatcaggatcaaagttgcttctgttgcgctatggagacgggggtgcgtatctacaatgtcgagccactgatggagaaggggcacttggatcacgagcaagtaggttctatgggactggtggagtag

SEQ ID NO: 55911 - DNA, 477 bp, Artificial Sequence
  Description of Artificial Sequence: Synthetic coding sequence
atgactcaacagccactgaggggagtcacgtctcttcgcttcaaccaggatcagtcatgtttctgttgtgctatggagacaggtgttagaatctataacgtcgaacccctaatggagaagggacatctggatcacgagcaggtgggaagtatgggattggttgagatgctccatcggtctaacctcctcgctctggttggcggaggctcatcacccaagttctccgaaatttccgttctcatctgggacgacgcgagggaggggaaggacagtaaggagaaactggtcctcgaattcaccttcaccaaacctgtgcttagcgttcgaatgagacacgataagattgtcattgttcttaaaaatagaatatatgtgtactcttttccagacaatccccgaaaactttttgagttcgatacacgagataatccgaaggcggctcatcctacccctcatctgcacacattaggtctttag

SEQ ID NO: 55912 - DNA, 879 bp, Artificial Sequence
  Description of Artificial Sequence: Synthetic coding sequence
atgacacaacagccacttcggggtgtgacttccctgaggttcaaccaggaccagagctgcttttgctgtgcaatggaaaccggagttcgaatatataatgtggagcctctcatggagaagggccatctaggactctgcgatctgtgccccagcctcgagaagcagctgctcgtgtttcctggtcataagtgcgggagcctccaactcgttgacttggcgtctactaagcccggaacatcttctgccccattcacaattaacgctcatcaatccgacattgcctgtgtgtctctgaatcagccaggaacggttgtggcttctgcaagccagaagggaacattgatacgcttatttgatacccagtcaaaagagaaacttgtcgaactccggaggggcacagatcccgcaactctttactgtatcaactttagtcacgattctagctttctgtgcgcctcctccgacaagggcacagttcatatctttgccctgaaagacactcgcttgaaccgcagatcagcgtacgtccgccctctccataccctcttgtcggccctggtggttgccgtggctcttggcgtcctggtgtgggcagccgagacccgtgccgcagttagacgatgtcgccgttctcaccccgctgcctgcctagccgctgtgctggccgtaggtttgctggtgttgtgggtggccggtggcgcatgtacatttctcttttcaatcgctggccctgtgctgctcatcctggtgcacgcatccttaaggctgcggaatctgaagaataagattgaaaataagatagaatcaatcggcctgaaacggactccgatgggcctgctgttggaggcactgggacaggagcaagaagccggatcttag

SEQ ID NO: 55913 - DNA, 630 bp, Artificial Sequence
  Description of Artificial Sequence: Synthetic coding sequence
atggattctgacgaaaccgggtttgaacactcaggcctgtgggtgagcgtgctggcaggtctcttgcttggcgcatgtcaggcccatccaattccggatagtagtccactgctacagtttggcggtcaggttagacagaggtacctgtacaccgatgatgcacagcaaacagaggcccacctggagattcgagaggatggaactgtaggaggagccgcagaccagagtcccgaatctctgttgcagctcaaagctctgaaacctggcgtgatccagattcttggagtcaaaacttccaggtttctctgccagcggccagacggggcactgtatgggtccctgcacttcgatcctgaggcctgctcattcagggagctactgctggaggatggctataatgtctatcagtcagaagcacacggactacccctgcatctccccggaaacaaatcaccccatcgggacccagccccaaggggcccagcacggttcctgccattgccgggtttacctccagctttgcccgagcccccaggaattctggctcctcaacctcctgatgtcgggtctagcgatccactgagtatggttggcccaagtcagggccgtagtccttcttatgcctcatag

SEQ ID NO: 55914 - DNA, 321 bp, Artificial Sequence
  Description of Artificial Sequence: Synthetic coding sequence
atgagcaccaacaacatgagcgatcctcgtagaccaaacaaggtcttacgctacaagcccccaccttccgagtgcaatcccgcattggacgatcccactcccgactatatgaatcttcttggaatgattttttccatgtgcggactgatgctcaagctgaagtggtgcgcgtgggtcgccgtctactgtagcttcatctctttcgccaattccagaagttctgaagacacaaaacaaatgatgtcctctttcatgctgtccatttccgctgttgtaatgagctatcttcaaaacccgcaacctatgacccccccatggtag

SEQ ID NO: 55915 - DNA, 2061 bp, Artificial Sequence
  Description of Artificial Sequence: Synthetic coding sequence
atgtcattcccgcgtggttcacagactcaaaaaattaaacaccctattggaactcggaaagggcctttagaagtgccaccacctaccgagaaggattggcccaaagacgatgagcaagaccatgtgctggttgatcccgacgaggaactggacagtcttcctcagccataccgcatgatcaataagctggtcaacctactttttgatcagtcatgggaaataattgaagaacgcaacgctctcagagaagcagaatcctctcagattcagcccacagtttatccccctctcggcgagatccagcttaataaaatgccaaattgtatggctgtctcccaggactacgtattcatcggcggagcaaagggctttagcatttacaacctctatagcgccaaacagatttatgcttgggaaaagctcaaggttgatgttacaagcatttgggcgactgatctgggcaatgaaatcctgatagctcccgtggatgagatggggattattagactgttctatttctataaggaaggcctgtatctggtgaaagcaatcaacgaagtcgacgatacaagtaagcagactacctgcattaaaatggaaatctcgcaggggggagatttcgctgctttcctactccaaggagccggagacatctggcttgacgtgtacaagctgcctaaggagacatggctgaagaaactggagcatccccaactgacatccaaccccaaaaagaaggtccgtcagcctcagcttaatagcctcggccctatttccgcggatccattggagatggacgccaatgtcagctttaaaggagatattaaactgtcgcttccagtgtacattatgaaaattaagcctcctaagccggtgaccggtacgacctttaaatcccccctggaagtttttgctaagattaaggattgttatggcctgggcagcggacagaatcattttattaaggacagtcagtgggaacagcaagcggagattttcaacgcgtcctataaaaaatacttggatcgtgagtgggaagaggagccattaagtactgctacattttactttctcctcccgagctgtctgttcgccatgcccccagaagtgaagggccctagtggtatggcctgtgtactggggatccactggactcgatctcacaatttttttctgtacagcctcaaccgtacactcaaagacaaagcggacccagaaggagtgtggccatgcgctgctcccatcgccgtctctcagctgtcttgtagcagctcatacctcgtcttggcttgcgaagacggggtgctcacgctgtgggatctcgcaaaagggttcccactcggagttgctgccttaccacaaggctgtttctgccagtcgatacactttcttaaatacttctctgttcataaggggcagaatatgtatcccgagggccaagtgaaaagccagatgaagtgcgtcgtcctgtgtacagatgctagtctgcacctggtggaagcctctggaacgcagggcccaactatcagcgtgctggtggagagacctgtgaaacatctggacaagactatttgtgccgtcgccccagtgcccgcactgccaggcatggtactgattttctccaagaatggatccgtgtgccttatggacgtagcaaagcgagagataatttgtgcattcgctccgccaggcgcattccctctcgaagtaccatggaaaccggttttcgctgtgtcccctgaccatccctgctttttgctgagaggcgactatagccatgaaacagcttcaaccgacgatgctggaatccagtacagtgttttctactttaactttgaggcttgtcccctgttggagaacattagcaaaaattgcactatcccacagcgtgacctggacaacatggcgttcccacaggcccttcctctggagaagcgatgtgagcgctttcttcaaaagtcatacagaaagctggagaagaaccctgaaaaggaagaagaacattgggctcgattacaacgttattctctttctctgcagagagaaaattttaaaaagtag

SEQ ID NO: 55916 - DNA, 1977 bp, Artificial Sequence
  Description of Artificial Sequence: Synthetic coding sequence
atgagctttccacgcggatcccagacgcagaagattaaacacccgatcgggactcggaaggggcctcttgaagtgcctccacctaccgagaaggactggcctaaggatgatgaacaggatcacgtccttgtggatccggatgaagaactagattccctgcctcagccataccggatgatcaataagcttgtgaatctgctctttgaccagtcttgggaaatcatcgaggagcggaacgctctgcgggaggccgagagttctcagatccaacctacggtctatccacctctaggagagatccagcttaataagatgcctaactgtatggcagtctctcaagactacgtgtttatcggcggagcgaaaggtttttcgatctataacttgtactctgcaaaacaaatctatgcttgggaaaaactcaaagtggatgtcacctcaatttgggcaaccgacctgggaaacgaaattctcattgctcctgttgatgagatgggcattattcgcctgttctatttttataaggaggggctgtatttggtcaaagctatcaacgaggtggatgatacgtccaagcagactacatgcataaaaatggagatttcgcaagggggagacttcgccgcatttctgttacagggagcaggggatatctggttggacgtctacaaattgccaaaagaaacctggctgaagaagctcgaacaccctcagctgacatctaacccaaagaagaaggtgcgccagccccagctgaattccctagggcctatttccgctgacccacttgagatggatgcaaacgtgagcttcaaaggtgacatcaagctgtcactgccggtgtacataatgaaaattaaaccacctaagcctgtaacgggtactacttttaagagccctcttgaagtttttgccaagattaaggactgctatgggctgggctcagggcagaatcacttcataaaggatagccagtgggaacagcaggcagagattttcaatgcctcctacaagaaataccttgatcgcgaatgggaggaggagccactctccactgcgaccttctactttttgctgcctagttgcctgtttgctatgcctcctgaggtcaagggcccatcagggatggcctgtgtgctaggcatccactggacccgtagtcacaatttcttcctctacagcctgaatagaacacttaaggacaaggccgacccagaaggtgtctggccgtgcgcggctcccatcgccgtcagccaactgagctgtagctcctcttacctcgtactggcgtgtgaagatggcgtgcttacactctgggacctggccaaagggcaaaatatgtaccccgagggtcaggtaaagagtcaaatgaagtgcgttgtgctgtgcaccgacgcgtccctgcaccttgtagaagcttccggcacacaaggcccaacaatctcagtgctggtggagcgacccgttaaacatcttgacaaaaccatctgtgccgtggcgccagtcccagccctccccggtatggtgctgatcttttctaaaaatggcagcgtatgtctaatggacgtagcaaaacgcgagattatctgtgcattcgcaccaccaggcgctttccccctcgaggtgccttggaagcctgtctttgctgtgtcaccagaccacccttgctttctgcttaggggagattacagccatgagactgcctctacggacgacgctggcatccagtattctgtgttttactttaattttgaagcctgccccttgctggagaatatctccaaaaattgcacaatcccccaacgggacctggacaatatggctttcccccaggcgctgccgcttgaaaagaggtgtgagcgctttctccaaaagtcatacaggaagctcgaaaagaatccggaaaaggaggaagaacattgggcccgattacaacgctattccctgagcctgcagagagagaatttcaagaagtag

SEQ ID NO: 55917 - DNA, 1341 bp, Artificial Sequence
  Description of Artificial Sequence: Synthetic coding sequence
atggaagctgaagcagcggatgctccacctggaggtgttgagtccgctctgtcttgtttcagctttaatcaggattgtaccagtttagccactggaaccaaggcaggctataagctgttcagcctatcatcggtggaacagcttgatcaggtacacggctcaaacgagatacctgatgtgtacattgttgagagactgttcagcagttccctcgtcgtggtggtatcacataccaaaccaaggcagatgaacgtgtatcactttaagaagggcacagagatctgtaactactcatatagctccaatatcctgagtatccggctcaacaggcagcgtctgctcgtgtgtctggaagagtcaatctatatccataatataaaagacatgaaactcctcaagacgttgttagatatcccggcaaatccaacaggtttatgcgcactgtccatcaaccactcaaatagttacctagcttaccccggttccttaacctcaggggagattgtgctctacgatggcaactctctgaagacagtgtgtaccatcgcggctcacgagggcacgctcgctgccattacgttcaacgcttcaggatctaagctggccagcgcgagtgaaaaggggacagtcattcgcgttttctcagtaccagatgggcagaagctttatgagttcaggagaggcatgaagcgctatgtgacaatctccagcctagtgttttccatggacagccaatttctttgcgcttctagcaacaccgagaccgtgcacatcttcaagctagagcaggtgacaaattccaggccagaggaaccgtcaacttggagcggttacatggggaagatgtttatggctgccactaattatctccccacacaggtgagcgatatgatgcatcaggacagagcctttgcgacagccaggctgaatttcagcggacaaagaaatatctgtacactaagtacgattcagaaattacctcggctactggtggcatccagtagcggacatttatatatgtataatctcgatccacaggatggcggagagtgcgtcttaattaaaactcattccctactgggatccggtacaactgaggaaaataaagaaaacgatctgcggccttctctgccgcaaagctacgccgcaaccgtagcgagacccagtgcctcctctgcctcaaccgtacccggttactccgaggacgggggtgccctacgaggggaagtgattcctgagcatgagttcgccacaggtccagtgtgtctggatgacgaaaacgaattccctccgattatactgtgcagaggtaaccaaaaggggaaaaccaagcagtcttag

SEQ ID NO: 55918 - DNA, 1095 bp, Artificial Sequence
  Description of Artificial Sequence: Synthetic coding sequence
atgaacgtctaccatttcaagaaaggcaccgaaatctgtaattatagttatagctcgaatattctgtctattagactaaatcgccagcgtctgctggtctgcctggaggagtcaatctatatccacaatattaaagatatgaagttgctcaaaactttgcttgacatccccgcaaatcccacgggtctctgcgcattatctatcaaccatagcaactcctatctggcgtaccctgggtccttgacctcgggagaaatcgtcctgtatgatggaaacagtcttaagacagtgtgtacaatcgctgcccatgaggggacattagcagctatcacttttaacgcatctggaagcaaactggcgtctgcatccgaaaaaggcaccgtgatcagagtgttttctgtgcctgacggtcagaagctctatgaattccgcaggggcatgaagcgttatgtgacgatctctagcctcgtgttctctatggatagccaattcttgtgtgctagctccaacacggaaacggttcacatcttcaaacttgaacaggtcaccaactctaggcccgaagagcctagtacatggtcaggatacatgggcaagatgttcatggcagccactaattacctccctacccaggtgtcagacatgatgcaccaggacagagcctttgccacagccagactaaacttttcgggacagcgcaacatttgtaccctctcaactattcagaagctacctcgactgctcgtggcaagcagcagcggccatctctacatgtataacctggacccacaggacggcggagaatgcgtgctgataaaaacacatagcctgcttgggtcgggaacaactgaagagaacaaagaaaatgacttgcggccatcactgccacagtcttacgccgcaactgttgcacgtccaagcgcttcatccgctagcacagtgccaggatactccgaggacggtggggcactccggggagaggtgatcccagagcatgagttcgccacagggccagtttgtcttgatgatgaaaacgagtttccaccaatcatattgtgcagagggaatcaaaaggggaagactaagcagtcgtag

SEQ ID NO: 55919 - DNA, 1365 bp, Artificial Sequence
  Description of Artificial Sequence: Synthetic coding sequence
atgaatctcgcaagccagtccggcgaggccggtgccggtcagctgctctttgccaactttaaccaggacaacactgaggtgaagggtgcttctcgtgcggcaggcctagggcgaagggcggtcgtttggtcactggcggtggggagcaagagcgggtataagtttttctccctgtcttctgtggataaacttgagcagatctatgagtgtacagacactgaagatgtgtgtatagtggagcgcctgttctcctcaagccttgtcgcgattgtctccctcaaagcacctcgcaagctgaaggtttgccacttcaaaaaaggtactgagatctgcaattactcgtattctaatactatcttagcggtcaaactgaaccgacagagattgatcgtatgcttagaggaatcactctacatccacaacatacgagatatgaaggtgctccacacaatcagagagactccgccaaatcctgctggcctgtgcgcgctgagtatcaacaacgataattgttacttggcatatcccggttcagccaccatcggcgaagtgcaagtgtttgatacaatcaacttacgagccgctaacatgatacctgctcacgatagtcccctggctgcgctggcttttgacgcatctggtacaaagttggccacggcttcggagaaggggaccgtgatccgggtcttttctattcccgaagggcagaagctcttcgagtttcgaaggggcgtcaaacgctgcgtgagcatctgctcactcgctttcagtatggacgggatgtttctcagcgcctcttccaacacagaaactgtgcacatcttcaaacttgaaaccgtgaaagagaaaccccctgaggagccaactacgtggacagggtattttgggaaggtcctgatggcatccacttcttacctgccatcacaagttacggagatgttcaaccaggggagagcatttgcaaccgttcgcctcccattttgtgggcataagaacatctgctctctagctactatccagaagatccccagattgctcgtgggagctgccgacggatacctgtatatgtacaatcttgacccacaggagggtggggaatgtgctctgatgaagcagcatcggctggatgggagtctcgagacgactaacgaaatactcgatagtgcatcccacgactgccccttagtcacacagacttacggcgctgccgcagggaagggcacctatgtgccatcttctcctaccagactcgcatacacagacgacctgggcgctgtgggaggcgcatgcctcgaagacgaagcctccgcgctgcgactggacgaagattccgagcatccacccatgatcctgcggaccgattag

SEQ ID NO: 55920 - DNA, 1314 bp, Artificial Sequence
  Description of Artificial Sequence: Synthetic coding sequence
atgctactgcgactgcaaaggataaagacactccggcctccaggatgtccgcatccgatgaccacatgctcagcaggcactctgagcgccgtgccttgcgtaagtcctcgccaggtgttcgtgtttgaaagacgcttttgtctgtggtcccatgtggagatgttcacgcacgtcctcccttttgttatctcggcggataccgaggatgtgtgtatcgttgaacggctgttctcaagtagcctcgtggcgatcgtgtcactgaaagcaccgaggaagctgaaagtttgtcatttcaagaagggcactgaaatctgtaactattcgtacagcaacacaattttagcagtgaaacttaacaggcagcgcctcatcgtgtgcttggaagagagcctctatatccacaacatccgggatatgaaggtccttcacacaatcagagaaaccccaccaaaccccgctggcttatgtgctctgtcaattaacaacgataactgttacctggcctatccgggttcagccaccattggagaggtccaggtgttcgacacaatcaacctccgggctgccaatatgattcccgcacacgatagccccttagcagccctggcctttgacgcgtctggcactaagctggctaccgcctcagagaaaggaactgtcatcagggtcttctctatacccgaaggacagaaactgtttgaattcagacgcggagtgaaacggtgtgtgtccatttgttcactggccttctccatggacgggatgttcctcagcgcctcgtccaacacagaaactgtgcatattttcaaacttgaaaccgtgaaggaaaagccccctgaggagccaaccacttggacaggatacttcgggaaggtgcttatggctagcacctcatacctcccatcccaggtgaccgaaatgtttaaccaagggagggctttcgccaccgttcggctgcctttttgcggccacaaaaatatttgctctctagcaacaatccagaaaattcccagactcctggtgggcgcagccgacggctatctctatatgtacaatcttgaccctcaggaaggtggtgagtgcgccttgatgaaacagcataggctggatggtagtctggagactacaaatgaaattttggactctgcgagtcatgactgcccactcgtgacccagacctacggagccgctgcagggaaagcttacactgacgatctgggcgcagtgggaggcgcatgtctggaggacgaagctagtgccctgcggttggacgaggacagcgagcatccacccatgatactgcgcacagattag

SEQ ID NO: 55921 - DNA, 1278 bp, Artificial Sequence
  Description of Artificial Sequence: Synthetic coding sequence
atgaacctggctagtcaatcaggagaagcaggcgctggacaacttctgttcgcaaattttaatcaggataatacaagcctggccgtagggtctaagagcggctataaatttttctccttaagttctgtggacaagttggagcagatttacgagtgcacagataccgaagatgtgtgcatcgtcgaaagattgttctctagctcccttgtggccatagtttcactgaaagcccctagaaagctgaaggtgtgccactttaagaagggaacagagatctgcaattattcctattccaatacaatcttggccgtgaagcttaacaggcagaggctgatcgtttgtctcgaagaaagcttgtacattcacaacattcgcgatatgaaggttctccatactattagggaaactccgccaaatccagctggcctctgcgctctgtcgataaataatgataattgctacctggcttaccctggttcagctactattggcgaggtacaggtgtttgacacaattaacttgcgcgcagccaacatgatacctgcacacgactcccctctggctgcgcttgcttttgacgccagcggcaccaagcttgctactgcatcagaaaaaggaaccgtgatcagagttttctcaatccccgagggccagaagctcttcgagttccggcgaggagttaagcgatgtgtctccatctgctccctcgctttttcaatggatggcatgtttctgtcagcttcctcgaacacagagaccgttcacatctttaagcttgagactgttaaagaaaaacctccagaggaaccaaccacttggacaggttactttggcaaggtgctcatggcatctacatcctaccttcctagtcaggtcacggagatgtttaatcagggtcgagccttcgccactgtgcgactccctttttgcggtcataaaaacatctgctccctggcaacgattcagaagatccccagactgttagtgggtgcagccgacggttacctctacatgtacaacctggaccctcaggaggggggagaatgtgcgctgatgaaacagcaccggctcgatggctcactcgagaccacgaacgaaatcctcgactcagcttctcacgactgccccttggtgacacagacatacggcgctgctgccggaaaagcctacactgacgatcttggggctgtagggggagcctgtttggaagatgaggccagcgccttgaggctggacgaggactccgagcatccacctatgatcctccgcactgactag

SEQ ID NO: 55922 - DNA, 1311 bp, Artificial Sequence
  Description of Artificial Sequence: Synthetic coding sequence
atgaatcttgcgtctcagtcaggtgaggctggcgcaggccagttactgtttgccaactttaaccaggataacacaagcctagccgtaggttcaaagtcaggatacaagttctttagcctaagctcagtggataagcttgaacagatttacgagtgcacggacacagaagatgtgtgcattgtcgaacggctgttctcgagcagtttagtggcaatcgtttctctcaaggccccaagaaaactgaaggtgtgccacttcaagaaaggtactgagatttgcaattactcttattcaaacactatcctcgccgtgaaactgaatcgccagaggctgattgtgtgcctggaggagtccctttatatccataacattagggatatgaaagtactgcataccattcgcgaaaccccccctaacccggcaggcctgtgtgcattgtcaattaacaatgacaactgctatctggcctatcccggatctgccacaattggagaagtgcaggtgttcgacaccatcaacctgagagctgccaacatgattccagctcatgactctccgctggctgccctggccttcgacgcctctggcactaagctcgcgaccgctagcgagaaaggcaccgtgatccgggttttttcgatacctgaaggccagaagctgttcgagttccggagaggtgtgaagcgctgtgtgagcatttgctccttagcgttctcaatggacggtatgtttttgtctgccagctcaaacaccgagaccgtccacatctttaaactggagaccgtcaaggaaaaaccccctgaggaacctaccacctggacagggtacttcggaaaggttctgatggcatccactagctacctcccatcacaggttacggaaatgttcaatcaaggcagagcattcgccacagtgcgtttgcctttctgcggccataaaaatatctgttcacttgccacaattcagaaaataccccgtctgctggtgggagctgccgatggctacctctatatgtacaatctggaccctcaggagggcggtgaatgtgccctgatgaagcagcataggttggatggctctcttgaaaccactaatgagatcttagattctgccagccatgattgccctctggtgactcagacatatggcgcagccgcaggtaaagggacctacgtcccctcatccccgactagacttgcttacactgatgacctgggcgctgtcgggggtgcttgtctggaggatgaggcctccgccctcagactggacgaggattcggaacatccccctatgattctgcgaactgactag

SEQ ID NO: 55923 - DNA, 1332 bp, Artificial Sequence
  Description of Artificial Sequence: Synthetic coding sequence
atgaatctcgcctcacagagtggggaggccggagctggccaattgctgttcgccaactttaatcaggacaatacagaggttaaaggagcaagccgggcagctggtttagggcgaagagccgtcgtttggtccctggccgtgggttctaagtctggctacaagtttttttctctgtccagcgtggacaaactggagcaaatctacgaatgtacagacacagaagacgtctgcatagtggaaaggttgtttagctcctcgttagttgccatcgtctccctcaaggcgcctagaaaactcaaagtctgtcacttcaagaaaggaaccgaaatatgcaattatagctatagcaatacgattctggcggtcaaactgaaccgacaaaggctaattgtgtgcctggaagagagcctctacatccataacatcagggatatgaaggtactgcatacaatccgagagactccccctaacccagcagggttgtgcgcgctctctatcaataacgataactgctatctggcttaccccggaagtgctacaattggagaggtgcaggtgtttgacacaattaacctgagagctgccaacatgatccctgcccacgactcaccgctggccgctttggcatttgatgcgagcggaaccaaactggccactgcatcagaaaagggaactgtaattagggtgtttagcatccctgaagggcagaagttattcgagttccggagaggggtgaagcgctgcgtgtccatttgttccctcgcattttcaatggatggaatgttccttagcgcctcaagcaacacagaaacggtccatatcttcaagttggaaacagttaaagagaagcctcccgaggaacccactacgtggaccggctacttcgggaaggttttgatggcctcaacatcttacttaccatctcaggtcacagagatgtttaaccagggacgggcttttgccacagtgcgccttcccttttgcgggcacaaaaacatttgtagcctggccaccatccagaagatcccaagactactcgtcggagcggcagatggctatttatacatgtacaacctggatccacaggaaggaggagagtgcgccctgatgaagcagcacagattggatgggtccttggagacaacaaacgagatcctggattccgctagccacgactgtccgctcgtgacccagacctacggtgccgctgctgggaaggcgtatacagacgatctgggagctgtcgggggagcctgcttggaggatgaagcctccgcactccgccttgatgaagatagcgagcatccaccgatgattctgcgcactgactag

SEQ ID NO: 55924 - DNA, 1155 bp, Artificial Sequence
  Description of Artificial Sequence: Synthetic coding sequence
atgtttacgcatgtactccctttcgtcatctccgctgacacagaggatgtgtgcatcgtggaaaggttgtttagctcatcactggtggcaattgtatctctgaaagccccaaggaagttaaaggtatgccactttaagaagggtaccgagatttgcaattactcttattcaaataccatccttgctgtaaaattgaaccggcagagactgatagtgtgtctggaggagagcctttacatccacaacatacgggatatgaaggtactccacaccattagggagacacctccaaaccccgcaggcctatgtgccctaagtattaataacgataactgttacctcgcctaccctggctccgccaccatcggagaggtccaggtgtttgacaccattaatctgcgcgctgctaacatgatccctgcacacgactccccactcgcagcgctggctttcgatgccagtggtacgaagctggctactgctagcgaaaaaggcaccgtgatccgtgttttttctattccagagggacagaaactgttcgaattcagacgaggcgtgaagaggtgcgtcagcatttgtagcctggcgtttagtatggatgggatgtttctttccgcgagcagtaacaccgaaacagtgcacatcttcaagttggaaaccgtcaaggaaaagccacccgaggaacccaccacatggactggctactttggtaaggtccttatggcctccacgtcttatttaccttcacaggtaactgagatgtttaatcagggaagagccttcgccactgtccgtctccctttctgcgggcacaaaaatatctgttctctggctaccattcagaaaattccgagactgcttgttggggcagctgacggctacttgtacatgtacaatttggatccccaagagggaggggaatgtgccctaatgaagcagcaccgtctcgatggttctctcgagacaaccaacgaaatattggactcagcctcccacgattgtcctttggtgacccagacgtacggcgctgctgccggtaaggcgtacaccgatgacctcggggcagttgggggagcatgcctggaggacgaagccagcgctctcagacttgacgaagattcagagcaccctcccatgattttaaggacagactag

SEQ ID NO: 55925 - DNA, 1035 bp, Artificial Sequence
  Description of Artificial Sequence: Synthetic coding sequence
atgaatctgctgccttgtaatccgcacgggaacgggcttttgtatgctggcttcaaccaggaccatggctgctttgcgtgtggaatggaaaacggattcagggtgtataacactgaccctttgaaagaaaaagaaaaacaggagttccttgagggcggagtgggccatgtggaaatgctctttagatgtaactatctggccttggtgggcggtggcaagaagccaaagtacccacctaacaaagttatgatatgggacgatttgaagaagaaaaccgtcatcgagatagaattttcaacagaagtaaaagcagttaagctgaggagagacaggatcgtcgtagtgctcgactctatgatcaaggtgttcactttcactcacaaccctcaccagcttcacgtgtttgaaacatgctacaatccaaaaggactgtgcgtgctttgccctaattccaacaatagcctgttggcctttccaggcacccacaccggacacgtccaactggtcgaccttgcatcaaccgaaaagcccccagtggacattcccgcacacgaaggcgttttgagctgcattgccctgaacttacaaggtacacggattgctactgccagtgagaagggcacacttatccggattttcgatacctctagtggacacctcatacaagagctgcgacgcggaagtcaggcggcaaacatttattgtattaacttcaatcaggacgcttctttgatttgcgtgtcatcagatcatggtacagtgcatatttttgccgcagaggatcctaaacgcaacaagcaatcatccttggcaagcgcctcatttctgcccaagtacttctcctctaaatggtctttctctaaatttcaggtcccctccggctctccgtgcatttgtgcctttggaaccgaacccaacgcagtgatagcgatctgtgctgacggaagctattataagtttttgttcaaccctaagggcgagtgcatcagggacgtgtacgcacaatttctcgagatgaccgacgataaattgtag

SEQ ID NO: 55926 - DNA, 951 bp, Artificial Sequence
  Description of Artificial Sequence: Synthetic coding sequence
atggagaacggcttccgggtgtacaatacggatcccctgaaggagaaggaaaagcaggagttcctcgagggaggagtgggccacgtcgagatgctgttccggtgcaactatctggcattagtgggaggaggaaagaagcctaaatacccacccaacaaggttatgatatgggacgacctcaaaaagaaaaccgtcatcgagatcgagttctcgacggaggtgaaggctgtcaaacttcgacgagaccggatcgtagtggtgctggattcaatgataaaggttttcacctttactcataacccacatcagctacacgtgtttgagacctgctacaaccctaaaggcctttgtgtcctttgccctaattccaacaactcccttctggcatttcccggaacccatactgggcacgtgcaactagttgacctagcctccaccgaaaagcctcccgtcgatatacctgctcacgagggggtgctctcttgtatcgcgctaaacctgcagggaacacgcatcgcaacagcatccgagaagggaactctgattagaattttcgacacatcatcagggcatctgattcaggaactgagacgcggatcacaggcagcaaatatttattgtatcaatttcaaccaggacgcctcactcatatgcgtgtcgtcagaccacggcactgtacacattttcgcagcggaagacccaaaaagaaataagcaaagtagtttggcttcagcgagcttcctccccaagtatttttcgagtaagtggtcattctcaaaatttcaggttcctagcggttcaccgtgcatctgcgcttttggtacagagcccaacgccgtgattgcaatctgtgcggatggctcatattacaagtttctcttcaaccctaagggagaatgcattagagacgtttatgctcagtttcttgagatgaccgacgacaagctttag

SEQ ID NO: 55927 - DNA, 1395 bp, Artificial Sequence
  Description of Artificial Sequence: Synthetic coding sequence
atggccctggtcgccctcgtggccggtgccagactcggtaggcgtctgtcagggccaggattaggacggggacattggactgccgctcggcgaagtcggagcagaagggaagctgctgaagccgaagcggaggtacctgttgtgcagtacgtgggagaaagggccgctagagctgacagagtgttcgtgtgggggtttagcttcagcggcgcactgggcgtcccaagttttgtggtgccttcatctggcccaggtcccagagccggtgcacgccctcgcagacgcattcaacctgtcccatatcggcttgagctagaccagaagatttcctctgccgcttgtgggtacggctttaccctcctcagctccaaaactgctgatgtgaccaaggtgtggggcatgggcctgaataaggactctcagctgggattccaccggtctcggaaggataagacacggggatatgagtacgttctcgaaccgtcccctgtctcactcccgctggatagaccccaggagacaagagtattgcaagtatcttgcggccgagcccatagtcttgtcctcacggaccgcgaaggtgtcttttccatgggcaataattcttacggtcaatgcggcaggaaagtcgttgaaaacgagatctattctgagagccaccgcgtacaccggatgcaggatttcgatgggcaggtggtgcaggttgcttgtggacaggatcactccctattcctaaccgacaagggggaagtctattcatgtggttggggtgccgacggtcagacaggactgggccactataacattacgagcagccctacaaagttgggaggggacctggccggtgtcaacgtcatccaggttgctacatacggcgattgctgcctggccgtcagcgcagatggaggtctgtttggctggggaaactctgagtacctgcagttggccagtgtgaccgacagcacccaagtgaacgtgcctaggtgcttgcactttagtggcgtggggaaagttagacaagccgcatgtggagggactggatgtgcagttctgaacggggaggggcatgtcttcgtttggggttatggcattctgggaaaaggccctaatctcgtagagtcggcagtgcccgagatgattccccctacattgtttggccttactgagttcaatccggaaattcaggtcagcaggattcgatgtggactgtcacacttcgcagccctgactaacaagggggaactttttgtttggggcaagaacatccgagggtgtctcggcatcggtaggctggaagaccaatacttcccttggagagtgacgatgcccggtgagccggtggacgttgcctgcggagtggaccacatggttacacttgccaagtcctttatttag

SEQ ID NO: 55928 - DNA, 1365 bp, Artificial Sequence
  Description of Artificial Sequence: Synthetic coding sequence
atggcactggtagcacttgttgccggagccaggcttggccgaaggttgtctggccctggactggggcgagggcactggaccgccgctagacgaagccgctctcgccgtgaggccgcagaagcagaggcagaggtacctgttgtccagtacgtcggcgaaagggcagccagggccgatagagtcttcgtttgggggtttagcttcagcggcgcattaggtgtgccgtcatttgtcgtcccctccagtggcccagggcctagagcgggagcacgtcccaggcggagaattcagcctgtgccatacagactggagctggaccagaagatcagcagtgccgcatgcggctacggcttcacacttctgtccagcaagaccgccgacgtgaccaaggtctggggaatgggcctgaataaagactcgcagttgggctttcatcgctctaggaaggataagacacgcggttacgagtacgtgctcgagccaagtccagtgtccttaccgcttgaccggcctcaagaaacaagagtgctgcaggtctcatgcggaagagcgcacagcctcgtgctcaccgacagggagggcgtcttttctatgggcaacaacagctatgggcagtgcggcagaaaagtggtagaaaacgagatttactcagagtctcaccgagtgcacaggatgcaagattttgatggccaagtggtgcaggtggcttgtggccaggaccattccctcttcctcacagataagggggaagtctactcctgcgggtggggtgcagatggccaaacaggtctcggccactacaatataacctcttcaccgaccaagctggggggtgacctggccggtgtcaatgttatacaggtggcaacttacggggattgctgcctggcagtctctgctgacggcggtctgttcggatggggaaacagtgaatacctccaactggctagtgtaaccgattcgacacaggttaatgtgccccgatgtttgcatttctctggagtgggtaaggtcagacaagccgcttgtggcggaaccggctgtgccgttctaaatggagagggtcatgtcttcgtgtgggggtatggaattttaggcaaaggtcccaacttagtcgagagcgctgtaccggaaatgatcccacccactctgttcggcctgaccgaatttaaccccgagattcaggtatctagaattcgttgcggactgtcacactttgcagctctcactaacaaaggggagcttttcgtatggggcaagaatatcaggggctgccttggaatcggccgattggaggaccagtactttccatggcgcgcacctgccccttcagcatcagccaagaccaccggcccactactgtag

SEQ ID NO: 55929 - DNA, 1077 bp, Artificial Sequence
  Description of Artificial Sequence: Synthetic coding sequence
atggctctggttgccctcgtggctggagctagactagggaggcgtctctctggtccaggcctcggcaggggccattggacggccgcacgcagaagtcgatcccggcgagaggcagcagaagcggaggccgaagtgcctgtcgttcaatacgtgggcgaacgagctgccagggccgaccgggtgtttgtctggggcttctcattttccggcgctttgggtgtgcctagttttgtggtaccgtccagtggcccagggccaagggctggtgcccgaccccgtcgacgaattcagccagtcccttatcggcttgaactcgaccagaaaatctccagtgctgcttgcggttacggctttacgctcctgtcaagcaagacggcggacgtcaccaaagtgtggggcatgggactgaacaaggactcccagctcggcttccacaggtctcgtaaagataagactcgcggatacgaatatgtgctcgaaccctccccagtctccctacctttagaccggccacaggagactagagttctgcaagtgagctgcggcagggcccactccctggtactgaccgaccgggaaggcgtgttctccatgggcaacaactcatatggacagtgcggacgcaaggtggtggaaaacgaaatttactccgaatcacaccgggttcacaggatgcaggatttcgacggccaagtcgtgcaggtagcctgtggtcaggaccactctctgtttctgactgataagggagaggtctactcctgcggatggggtgctgatggacagaccggcctcggacactacaatattacatcctcccctaccaagctgggcggtgatctggccggagtgaatgtgatacaggtcgccacctacggggactgttgcttggctgtgtcggccgatggagggctttttggctgggggaattcagagtatcttcagctggcgagtgtgaccgattcaactcaggtaaacgtgccaaggtgcctccacttttctggagtcggaaaagtgcgccaggccgcatgtgggggtacaggttgtgcagtactgaatgatacgtggccacaaagttag

SEQ ID NO: 55930 - DNA, 1797 bp, Artificial Sequence
  Description of Artificial Sequence: Synthetic coding sequence
atggccagcctgcgaagagtgaaagttctcctagtgctcaacctaattgctgtggccggattcgtgctcttcctggcaaagtgcaggcccatcgctgtcagatcaggggacgcattccatgaaatcagaccgcgagcagaggtggcaaacctgagtgcccattccgcaagtcctatacaggacgcagtgctaaaacggctgtccctgctggaagatatcgtttaccgacagctcaatggcctctcaaagtctcttgggctcattgagggttatgggggtcggggaaaaggcggtttgcccgctactttgtcacccgctgaagaggaaaaagccaagggcccacacgagaaatatggctacaactcctacctctcagagaagatttccctggaccgttctatccctgattatcgccctaccaagtgcaaggagctaaaatatagcaaagacctgcctcagatcagtatcattttcatttttgtgaacgaagccttgagtgtgattctcaggagtgtccatagtgcggtaaaccacacacccacccatctcctgaaagaaatcattttggttgacgataattcagatgaagaggagctcaaagtgcccttagaggagtacgttcacaagcggtaccccggactcgtcaaggttgttaggaaccagaagagagaaggcttgatacgggctcggatcgaagggtggaaggtggccaccggccaggtcacaggcttctttgacgcccatgtggagtttaccgcagggtgggcagaaccagtgctcagccgtatccaagagaacagaaagagagttattttgccgtccatcgacaatattaagcaggacaatttcgaggtccagaggtacgaaaactccgcccacggttattcttgggagctgtggtgtatgtatatctccccgcctaaggattggtgggacgccggagaccctagtttacctataagaacgcctgccatgatagggtgttcatttgttgtcaataggaaattcttcggggagattggtctgctggatcctggtatggacgtttacggaggcgagaacatcgaacttgggatcaaagtttggctatgcggaggcagcatggaggtgctcccctgcagccgcgttgcccatatcgaaagaaagaagaagccttacaactccaatattggattctacaccaaaaggaacgcgcttcgcgtggccgaggtgtggatggatgattacaagagccatgtgtacatcgcttggaaccttcccctcgaaaatcccggaatagacatcggcgatgtcagcgaacgtagagccctcaggaagtccctgaagtgtaaaaatttccagtggtacctggatcatgtgtatccagagatgcgaaggtataataataccgtagcttacggcgaactgcgcaataacaaagcaaaagatgtttgtctggatcagggccctctggaaaaccacaccgccatattatatccttgtcatggatggggtcctcagttggcaaggtatacaaaggagggcttccttcatctcggcgctctcggaactacaacactactgccggatacaagatgtttggtcgataattctaaatctagactaccccagcttctagactgcgacaaggtgaaaagcagtctgtataaacggtggaactttatccagaatggggctattatgaataaaggaacagggaggtgcctcgaagtggagaaccgcggtctggccggaattgaccttatcctgcggagctgcactgggcagagatggacgattaaaaactccatcaagtag

SEQ ID NO: 55931 - DNA, 1728 bp, Artificial Sequence
  Description of Artificial Sequence: Synthetic coding sequence
atggccaaaccattttttcggctgcagaagtttctccgccgtacacagttcctcctcttctttcttaccgccgcttatttaatgactggctctctgttgttacttcagcgcgttagggtggccctgccacagggtcctcgtgcccctgggcctctgcaaactttgcccgtggctgcagtcgctttgggagttggactgcttgacagtcgagcactgcacgacccgcgtgtgagcccagagctcctccttggcgttgacatgttgcaatcccccttgacccggcctaggcccggacccaggtggctgcgttcgcggaattctgagctgcggcagctgcgacgtaggtggttccaccatttcatgtcagactctcaggggccaccagctctcggacctgaagcagctcgtcccgcaattcacagccgcggaacatatattggctgctttagcgatgatggacatgaacgaactctgaagggggcagtgttttatgacctgcgcaaaatgactgtgtcacactgccaagacgcctgcgcagaacggagctacgtgtacgccggtctggaagctggtgcggagtgctattgtggtaatagactgcccgcagtttcagttggcttggaagagtgtaatcatgagtgtaaaggggaaaaaggctcagtatgtggggctgtggatcggttgtccgtctatcgtgtagacgagctccagcctggctctaggaagcgcagaacagccacatatcggggatgtttcaggctccctgagaatatcacacacgcattcccctcctccctcatacaggcgaatgtgaccgttggcacctgctccggcttctgctctcaaaaagagttccccctggccatcctccgaggttgggaatgttactgcgcctatcccaccccaaggttcaatctgcgggacgcgatggatagttctgtgtgcggccaggacccggaggctcagcggctggctgaatactgcgaagtttaccaaactcctgtccaggacacacgatgtaccgaccggagattcctgccgaataaaagcaaggtcttcgtggccttatcttccttccctggtgccggaaacacctgggctaggcatttgattgaacacgccacaggattctacacgggatcctactattttgatgggactttatacaacaaaggatttaagggcgagaaggatcactggagatctaggcggaccatatgcgtcaaaactcatgaatctgggcgtagggagatcgaaatgtttgacagtgctatattgttaatccggaacccatatcgatctctggtggctgagttcaatcgcaaatgtgcaggacatttgggctatgccgctgatcggaattggaagtctaaagagtggcctgatttcgttaatagctacgcctcctggtggtcctcccatgtactggactggttgaagtacggtaaacgcctgctggtggtccattacgaggaattacggagaagtctcgtgccgacgttgagagaaatggtggctttcctaaacgtgtcagtgtcagaagaaaggctactctgcgtcgagaacaataaggagggcagcttcagacgcaggggccgacggtctcacgacccagaacccttcactccagagatgaaagacctcatcaatggatatattagaactgtagatcaggccctaagagaccataactggacgggactccctcgggagtatgtccccaggtag

SEQ ID NO: 55932 - DNA, 1728 bp, Artificial Sequence
  Description of Artificial Sequence: Synthetic coding sequence
atggctaaaccattcttccgtttacagaaatttctgcggaggactcagttcctgctattcttcctgacagcggcttatctgatgaccgggagcctcctcctgttacaaagagttcgcgtggctctaccccaaggccctagggctccagggcctctgcagacgttgcccgtggccgctgtagccctcggggtggggttgctggactcccgtgcgctgcatgacccacgcgtaagtcccgaactgctcttgggggtggatatgttgcagagtccccttaccagaccgagacccggacccaggtggttgcggagtcgtaacagtgagctgcgacagctgcgtaggcgctggtttcaccactttatgagcgattcccagggacccccagccctgggacccgaggctgctagaccagctattcattctcggggaacttacatcgggtgcttcagcgacgatggtcacgaacgaacactgaaaggcgcagttttctacgatctcagaaaaatgacggtctcccattgccaggacgcttgcgcagagagatcctatgtatacgccggtctggaggctggggcagaatgttattgcggcaaccgactgcccgcagtctccgtcggcctagaagagtgcaatcacgagtgtaaaggcgagaaggggtccgtctgtggggctgtggaccgattgtccgtgtacagggtggacgagttacaaccagggagccgaaagcggcgaactgctacttataggggatgtttcagattgcctgaaaatattacccatgcattcccctcgtccctgatacaggccaatgttacagtgggaacatgttcaggtttctgtagtcagaaagaatttcccctggccattttacgcggatgggaatgctattgcgcttatccaacacccaggtttaacctgcgggatgccatggatagtagtgtctgcgggcaggacccagaggcccaacggctggctgaatactgcgaggtctatcagactcctgttcaagatacccgatgcacggatcgcagattcctacctaacaagagtaaagtatttgtggcactctcctcctttcccggtgctggaaacacttgggcgagacatctgatagagcacgccaccggcttttacactggatcttactacttcgatggtaccctctataacaaggggtttaaaggggagaaggatcattggaggtctcgtaggaccatttgcgttaaaacacacgagagcggccgtagagagatcgaaatgtttgacagtgccatcctcttgattagaaatccatacaggagccttgttgccgagttcaaccgcaaatgtgccggacatctgggatatgccgcagaccgcaactggaaatctaaggaatggcccgatttcgtgaacagctacgccagctggtggagcagccatgtgctggattggctgaagtatgggaagaggcttctggttgtccattatgaggagttgcggaggtctctggtaccgaccctgagggaaatggtcgccttccttaatgtatcagtttccgaggaaaggctgctgtgcgtagaaaataataaagaaggcagttttcgcagacggggtcgtaggtcacacgatcctgagccatttacaccagagatgaaggacttgataaatggatacatccgtaccgtcgaccaggccctgagggaccataattggactggacttcccagggagtatgtccccaggtag

SEQ ID NO: 55933 - DNA, 1758 bp, Artificial Sequence
  Description of Artificial Sequence: Synthetic coding sequence
atggccaaactttggttcaagttccagcgctactttcggaggaagccagtacggttttttacattcctggctttgtacttgaccgcgggaagcctggtctttctgcattctggctttgttggacagcccgcagtgtctggcaaccaggctaatcccgctgcggcaggcggacccgcagagggagccgaactgagtttcctcggggacatgcatctggggcgaggcttccgggacaccggggaggcctccagtatcgccagacggtacggcccttggtttaaaggaaaagacggcaacgaacgggctaaacttggagactacggcggtgcatggagcagggcactcaaaggcagggtcgtaagggagaaggaggaggagagggccaaatacattggttgctatcttgacgatacccaaagccgcgcattgcgcggtgtaagcttctttgactataaaaaaatgaccattttccggtgtcaagataactgcgcggaaagagggtatctctatgggggactggaatttggagcggagtgttattgcggacacaaaattcaggccaccaatgtgtctgaggcggaatgtgacatggaatgcaagggcgaaagaggatcagtgtgtggcggtgcgaacagactttccgtctacaggcttcagctcgcccaggagagtgccagacgctatggatcggccgtgttccgcggttgctttcgcaggcccgataacctcagtctggcactccccgtcaccgctgccatgctgaatatgagcgttgataaatgcgtggacttctgcacggagaaggagtacccactggctgctctagccggaaccgcatgccactgcggattcccaaccactcgcttccccctgcatgatcgagaggacgaacagctgtgtgcccagaagtgctctgccgaggagtttgaaagttgcggtactccttcctacttcatcgtgtaccagactcaggtgcaggataataggtgcatggataggagatttctcccgggtaagagcaagcagctgatagccctcgcgtcgtttccaggagctggcaatacttgggcaaggcacctgattgagctcgcaaccgggttttacaccggttcctactatttcgatggaagtctctataataaggggttcaaaggtgagagagaccactggagatctggcaggacaatttgtatcaagacccatgagagcggccagaaggaaatcgaggctttcgatgccgctattctgctgattcggaacccatacaaagcactcatggccgagttcaatcggaagtatgggggacatataggatttgcagcccacgctcactggaagggtaagggggcagtcccgggtagtcttcagattctgttcaggtctatttgcactgccagcgttggtgaatggcccgagttcgtccgaaattatgctccttggtgggccacacacaccctggactggctgaaatttgggaaaaaagtattggtggtgcatttcgaggacttaaagcaggacctttttgtccagctgggacggatggtctctctgcttggagtcgctgtgagagaggaccggctgctgtgcgtcgaatctcagaaggacggaaattttaagcggagcgggcttagaaagctcgagtacgacccatacacagccgatatgcagaagaccatttcagcctatattaaaatggtcgatgctgctcttaagggcagaaaccttactggtgtgcctgacgactactatcccagatag

SEQ ID NO: 55934 - DNA, 1698 bp, Artificial Sequence
  Description of Artificial Sequence: Synthetic coding sequence
atggctaagctgtggttcaaattccagaggtacttcaggcgcaagccagtgaggttctttacatttctggctctgtacttgaccgcaggatcgttagtctttctccattcgggatttgtgggtcaaccagccgttagtggcaaccaggctaaccctgccgcagcaggtgggcctgccgagggagccgaattgtcgttcctgggcgacatgcatttgggacgcggatttagagacacgggagaggcctcctccatcgcaaggaggtacggcccttggttcaaggggaaggacggcaacgagagggctaaactaggagattatggcggagcatggagccgggcactgaagggccgagtggtgcgggaaaaggaagaagaaagggctaagtacatcggttgctacctggacgacacccaatcgcgcgcactgaggggagtgtccttcttcgattacaagaagatgaccatctttcggtgccaggacaattgcgccgaacggggttatctgtacggcggattagagtttggcgcagagtgttactgtggccacaaaatccaggcaaccaacgtgtctgaagcagaatgcgatatggaatgcaaaggcgagagagggtcagtgtgcggcggagctaaccgcctgagtgtgtaccgcttgcagctggcacaagagtccgcccgtagatatggttcggccgtttttcggggatgttttcggagacctgataaccttagcctggctcttcccgtgactgcggctatgctgaatatgtctgttgacaagtgcgtggatttttgcaccgagaaggaatacccactggccgctcttgcaggtactgcgtgtcactgcggctttccaacaactcgctttcccctgcatgaccgcgaggacgagcagctctgcgcccagaaatgctccgccgaagagttcgaaagttgcggcacgccgagttacttcattgtatatcagactcaggtccaggataacagatgtatggatcggcgattcctgcccggaaagtctaagcagcttattgcactggcaagttttcctggggcaggaaacacctgggccaggcatcttattgaactggcgaccggcttttacaccggaagttactacttcgacggtagtctctacaataaaggctttaaaggtgagagagaccattggagatcaggtagaaccatttgtatcaaaactcacgagagtggacagaaagaaattgaggcatttgacgctgcaattctcttaattaggaatccttataaggccctaatggccgaattcaataggaaatatgggggacacatcggcttcgccgcacacgcccattggaaagggaaggagtggcccgagttcgtaaggaattatgccccttggtgggcaacccacactctggattggctaaaattcgggaaaaaggtgctcgtagtccactttgaagacctgaaacaggacctcttcgtgcaactcggaaggatggtgtccctcctgggggtcgcagtgcgtgaagaccgcttgctctgtgtggagagtcaaaaggacgggaatttcaagcgaagtggcctacgaaagctcgaatacgacccttatacagccgacatgcagaaaactatttcagcttacatcaaaatggtggacgctgcacttaagggcaggaacttaacgggagtgcccgacgactattaccccagatag

SEQ ID NO: 55935 - DNA, 1698 bp, Artificial Sequence
  Description of Artificial Sequence: Synthetic coding sequence
atggccaagctgtggttcaagttccaacgctactttagaagaaaacctgtccggttttttacttttcttgccctctatctgacagcagggtcactcgtgttcctgcactccggattcgtcgggcagcctgcagtgtctggcaatcaagcaaacccagcagcggcaggtgggccagccgaaggggctgagttaagcttcctcggggatatgcatctgggaaggggcttccgcgacacaggcgaggcaagctcaatcgctcggcgttacggcccatggttcaagggcaaagacggaaatgaacgggcaaaacttggggattacggcggagcttggagcagggccttgaaggggcgtgtggtaagagagaaagaagaggaaagggctaagtacatcggttgctacctcgatgatacacagtcccgagctctgaggggagtttctttcttcgattacaagaagatgacaatcttccgatgccaggataattgtgctgagaggggctacctgtacgggggactagagttcggggcagagtgctactgcggacataagatccaggccacgaacgtgtctgaggcagaatgtgatatggaatgtaaaggagagcgcggaagtgtctgcggcggagctaatcggctaagtgtttataggctacagctcgcacaagaatcggcccgaagatacggcagcgccgtcttccgcggttgctttcgcaggccagacaatctgtctttagcactgccggtcaccgcggcaatgttgaacatgagcgtggataagtgtgtagatttctgcacggagaaagaatatcccctggccgctctcgccggtacggcttgccactgtggctttcccacaactagatttccactacacgatcgggaggacgagcagctgtgcgcacagaagtgtagtgccgaagagttcgagtcttgtggcaccccatcctacttcattgtttaccaaactcaggtgcaggacaatcggtgtatggataggcgcttcttgcctggaaagtccaaacagctgatcgcacttgcctcatttccgggagccggaaatacttgggcccgacatctgattgagctggcaaccggtttctataccggcagctattatttcgatggctctttgtataataaaggattcaaaggagaaagggaccactggcggtcaggaaggaccatatgtattaagacccacgaatctggccaaaaggaaatcgaggcctttgacgcggctatcctgctgatacgaaacccttataaggctttaatggccgagtttaatagaaagtacggagggcacattggatttgccgctcatgctcactggaaagggaaggagtggccagagtttgttaggaattacgctccctggtgggctacgcacaccctggactggcttaagttcgggaaaaaagtgttagtggtgcactttgaagacttaaagcaggatttgtttgtccagcttgggaggatggtgagcctcctaggggtcgccgtcagggaagaccgcctcctgtgcgtggagagtcagaaagacgggaatttcaagagatctggcttacgcaaactggagtatgacccgtacaccgccgacatgcagaagaccatctctgcttacatcaagatggtcgacgcagcactgaagggacgcaacttaactggggtgcccgatgactattacccaaggtag

SEQ ID NO: 55936 - DNA, 1758 bp, Artificial Sequence
  Description of Artificial Sequence: Synthetic coding sequence
atggccaaattgtggtttaagtttcagcgttattttcggcgtaaacctgtgaggtttttcacctttctggctctctatctgacggccggatcccttgttttcctgcactctgggttcgttggacagcctgctgtttcagggaaccaagccaatcctgctgctgctggcggaccagctgagggggcagaactgtccttcctgggagacatgcacttaggcagaggcttcagagatacaggagaagcatcttcaatcgcaaggcggtacggaccttggtttaagggcaaggacggtaatgagcgcgcaaagctgggcgattatggaggggcatggagccgggcactgaaagggcgtgtcgttagagagaaggaggaggaacgcgctaaatatatcgggtgttacctagatgacactcaatctagagctttgcggggtgtctcgttctttgattataaaaaaatgacaatattcaggtgccaggacaactgcgcagagcgcggatacttatacgggggattggaattcggggcagaatgttattgcgggcacaaaatccaagccaccaacgtgagtgaggctgagtgcgatatggagtgtaaaggggagcggggttccgtatgcggcggagcaaatagattgtccgtgtacagactccagctggcacaagaaagcgctaggcggtatggaagcgcagtctttagagggtgcttccgccgtccagataacctctcccttgctctgcccgttacagccgcaatgcttaacatgtccgttgataaatgcgttgatttttgcacggagaaggaataccctctcgcagctcttgccggtaccgcatgccactgtgggttccctaccacccggtttccattgcatgacagagaggacgagcagctgtgtgcccagaagtgttcagccgaggaattcgagagctgcggaacaccttcctattttatcgtgtaccaaacgcaagtccaggataacaggtgtatggatagaaggttcctgcctgggaaatccaaacaacttatagccctggcgtctttcccaggagccggaaacacttgggctcggcatcttatcgagctggccacgggattttataccgggtcttattattttgacggctccctctacaacaaggggttcaaaggagaaagagaccattggcgctctggccgaacgatttgcatcaagacacacgagtccgggcagaaagagatcgaagcattcgacgctgccattcttctcatacggaacccgtataaggccctgatggccgagttcaatcgcaaatacggaggccacattggctttgccgctcatgcgcactggaagggtaagggcgctgttccaggctctctccaaatcttgttcaggtctatctgtaccgcatccgttggcgaatggccggagtttgtgagaaactatgcgccatggtgggcaacgcatacactggattggctcaagtttggtaaaaaggtcctggttgtccatttcgaagacttaaagcaagatctgtttgtgcagctcgggaggatggtatccctgctgggagtggccgtcagagaagataggctcctctgtgtcgagagccagaaggacggcaattttaaacgaagtggtctccggaagctggaatatgacccatacaccgccgacatgcagaagaccatttccgcgtacatcaaaatggtggatgccgctttaaaaggaaggaacctgactggagttcccgatgactactatcctcggtag

SEQ ID NO: 55937 - DNA, 5531 bp, Artificial Sequence
  Description of Artificial Sequence: Synthetic coding sequence
atggccgacacccagacacaagttgccccaactccaacgatgcggatggccactgccgaggacctgcccctgcctcctcctcccgctctggaggatctgccattaccaccccctaaagaaagtttctcaaaattccaccagcagcggcaggcgtctgaactgcgacggttgtatcggcacattcacccagaactacggaaaaacttagctgaagccgtggccgaagacttggctgaggtgctgggaagcgaagagccaacagaaggcgacgttcagtgtatgcgttggatctttgagaattggcgcctcgacgccattggggaacatgagcgtcccgcagcaaaagaaccggtgctgtgtggtgatgtgcaggccactagccgcaaatttgaggaagggtcctttgcgaattccaccgaccaggaacctacccgtccgcagccgggaggcggagatgtgagggcggctcggtggctgtttgagaccaaacccctggatgagctgactggacaggctaaagagctcgaggcaacagtacgcgagccagccgcttcaggagacgtacagggcacccgtatgcttttcgagacacggccactggataggctgggttcacggccatcgctgcaagagcaaagcccgctggaactccgatcagaaattcaggagttaaagggggacgtaaaaaagactgtcaaactgtttcaaacagagccactttgcgccattcaggacgctgaaggggctattcatgaagtcaaggcggcatgccgtgaagaaatccagagcaacgcagtgcggtctgcacggtggctgttcgaaaccaggcctcttgacgccatcaatcaggaccctagccaggtgcgagttatccgtggaatttccctggaagagggagctcggccagacgtgagcgcaacgcgatggatttttgagactcagccattagatgcaattcgtgagatactggtcgacgaaaaggatttccagccctcgccagacctgattccaccgggacctgacgttcaacagcagcagcatttgttcgagactcgcgctttggataccctcaagggcgacgaggaagccggagctgaggctcctcccaaggaggaagtcgttcccggagacgtccgcagcacactgtggctgtttgaaacaaagccgctagatgctttccgggataaggtccaggtggggcacttacagagagtggatccgcaggatggagaagggcacctgagctccgatagttcctctgccctgcctttcagccagagtgcccctcagagagacgagctcaaaggcgacgttaaaacgttcaaaaatttattcgaaacgttgcctctggacagtattgggcagggggaagttttggcacacgggtccccatctcgcgaagagggcactgattccgccggtcaggcccagggtatcggcagccctgtatatgctatgcaggatagtaagggaaggctgcacgccctaacttctgtctcaagagagcaaattgtcgggggagatgtgcagggataccggtggatgtttgagacacagcctctagaccagctgggtcggtctccatcaacaattgatgtcgtacgcggaattactagacaagaggtcgtggcaggtgatgttggtactgcaagatggctttttgaaactcagccccttgagatgatccaccagcgagaacagcaagaacggcagaaagaagaagggaaatctcaaggcgatcctcagcccgaggcacctccaaaaggtgacgttcagacgatcagatggctgttcgaaacatgtcccatgtccgagctggccgagaaacaaggctctgaggtgactgatcctactgcaaaggcagaggcccagtcctgcacgtggatgtttaagccacaacccgtagaccgtccagtagggtccagggagcagcacctgcaggtttctcaggtcccagctggagaaagacagacagacaggcacgtgttcgagaccgagccattgcaggcatcaggcagaccgtgcggcagaagaccggtgcgctattgcagcagagtagagatccccagcggccaagtgagtaggcagaaggaggtgtttcaggcactggaagcaggaaaaaaagaggagcaggaacctcgagttatcgctggttccattccagccggatcagttcacaagttcacttggctatttgagaactgtcctatggggagcctggcagcggaatccattcagggcggtaatctccttgaagagcagcccatgtccccttctgggaacaggatgcaggagtctcaggaaactgccgctgaaggaaccctgcgcacactccacgcaacaccaggcattctccaccacggtggcatcctgatggaggcccgagggcctggtgaactttgcttggcaaaatacgtactttctggcactgggcaggggcacccctatatcaggaaggaggagttagtttccggcgagctgcccagaatcatctgccaggtactccggaggcccgacgttgaccagcagggcctgctagtacaagaggaccccactggccaattgcagcttaagcctctgagattgcccacacctggcagcagtggtaatatagaagacatggatcccgagctgcaacaactgctcgcatgcgggctggggactagcgtcgcgagaacaggtttagtcatgcaggagaccgaacagggtctcgttgcactgactgcttacagcctgcagcctcgtcttacatccaaagcatccgagaggtcctctgttcagctgctggccagttgtattgacaagggcgatctcagcggactgcactcgctgcgatgggaaccaccagccgatccaagtcccgttcccgctagcgagggggctcagagcctccacccaactgagagtattatccatgttccccctctggacccttccatgggcatggggcacctgagagcttctggagctactccgtgcccacctcaagctatcggcaaagcagtgccgttggccggtgaggcagccgctccggctcaactccaaaatactgaaaagcaggaggactcccattctggacaaaaggggatggcggtgttgggcaagagcgaaggtgctaccacaacccccccaggccctggcgctcccgacctcctcgccgctatgcagtcactcaggatggcaactgcagaagcccagtctctgcaccaacaggtgctcaacaaacataagcagggacctacccccaccgctactagcaatccaattcaggacggcctgcgaaaggctggagctactcagtccaacatcagacccggaggaggcagcgacccacggataccagcggcaccaaggaaagtgtcaagagaggaacaagccctgcccagaggattgccaggcggatgggtcacaattcaggacggaatttacacagcccacccagtgcgtacctttgatccacccggaggagtgcaattaagccagagagaaccccagagcaggcatcgggagaccgcactgagcgtgcaagcccctaggccactgcaagggggacccggacagagtaccggcccaggacgggaagagcccggtggctgcactcagatggcctgggggcctcctggcaaggctatggcagaggtgtgtcctggaggcctccaggccgctgagacaacactgaagactgcaccactcggccgacacatactcgcctccggcccacaggccgctggagcatcccctcacccccataatgctttcgtacccccacctcctacgctgccagccgcagttacaggcccagatttccctgcaggagcccacagagcggaagatagtatccagcaagcgagcgagccactcaaggatcccttgctccacagtcactcttcacctgccggacagaggacccccggaggatcacagacaaagacacccaagctcgaccccacaatgccaccgaagaagaagccccagctgccgccaaaaccggctcacctcacccagagtcatcctccccagaggctgccaaagccccttcccctgtcgccttccttctcctccgaggttggccagcgggaacaccagcggggtgagcgcgataccgcaataccgcaacctgcaaaggtgcccacgaccgtggaccaagggcacattcctctcgccaggtgtccaagcgggcactcccagcccagtctgcaacacggactcagcaccacagccccaaggcctaccaagaatcaggcgaccgggtccaacgcccagtcttctgagcccccaaaactgaacgctctcaatcacgacccgacatccccacagtgggggccaggcccatcaggtgagcaacccatggaagggagccaccagggcgctccagagtctccggattcgctccaaagaaatcagaaggaattgcaggggttgttgaatcaggtccaggcattagaaaaggaagcagccagcagtgtcgacgttcaggctttgcggagattgttcgaagcggtgccacaattggggggtgccgcaccccaggcgcctgccgcacaccaaaaaccggaggcaagtgtggaacaggcctttggcgaactcaccagggtctccacggaagttgctcagctcaaggagcagaccctggctcgcttgctggacatcgaggaggcagtgcacaaggccctcagctctatgagtagtctccagccggaggcttccgccagagggcactttcagggaccacctaaagatcatagcgcccataagatcagtgtcaccgtgtctagcagtgcgagaccctctgggagcggccaggaagtgggcggtcagacagctgttaaaaaccaggcaaaggttgaatgccacaccgaagcgcagtcgcaagtgaaaataaggaatcatacagaggctcggggtcacactgcatctactgctccatctacccgaaggcaggagacctcacgggagtacctgtgtcccccaagggtgttacccagctctagggattcacctagcagccctacttttataagcattcaatcggccaccaggaagcctcttgaaacaccctcttttaagggaaatcctgacgtgagcgtaaagagtacacagctcgcccaagatattgggcaggcactccttcaccagaagggtgtccaggacaagaccggaaagaaagacattacccagtgctcggtgcagcctgagcccgctcccccttctgcctctcccttgcctcggggatggcaaaagagcgttttagaactgcagacgggccctgggagctcccagcattacggcgcaatgaggacagtcacagaacagtacgaggaggtggaccaattcgggaataccgtgctgatgagtagcactacagtaactgagcaagctgaacctccccgaaatccgggtagccaccttgggttacacgcaagcccgctcctccgtcagttcctgcactcccccgctggctttagtagtgatctcaccgaggccgaaactgttcaggtcagctgcagctactctcaacccgctgcccagta

SEQ ID NO: 55938 - DNA, 3366 bp, Artificial Sequence
  Description of Artificial Sequence: Synthetic coding sequence
atggcagatacccaaacgcaagttgcccctacgccaacgatgcgaatggcgacggcagaggatctgccactgcccccaccaccggcactcgaagacctgcctctcccccctccaaaggaatcattctccaagttccaccagcagaggcaagcgtccgagctgagaagactgtaccgacatatccatcccgagctgcgtaagaatctggctgaggccgtggctgaggacctggctgaggttctagggagtgaagagcctaccgagggcgatgtgcagtgtatgaggtggatcttcgaaaattggcgcctcgatgcgataggtgaacacgaacggccagcggctaaagaacctgtactgtgcggcgatgtgcaggcaactagcagaaagtttgaagaaggctcattcgccaactctactgatcaagagcctacccgccctcaacctggcggaggggacgtgcgcgctgcgcgttggctgttcgagaccaagccgttggacgagctgacaggccaggccaaggaactggaggccactgtaagggagccggctgcatcaggcgatgttcaaggcaccagaatgctgtttgagacccggcctttagaccgcttaggctctcgcccttctcttcaggaacagtcacctctagaattgcgctcagagatccaagaacttaagggagacgtgaagaagactgtcaagctgtttcagaccgagcctctgtgcgcaatccaagacgcagagggggctatccacgaagtaaaggcagcctgtagggaagagatccagagtaacgcagtaagatcagctcgatggcttttcgaaactcgaccgttagatgctatcaaccaagatccctcccaggtgagggtgattaggggtattagcttggaggaaggcgctagacccgatgtcagcgcgacccgatggatcttcgaaactcagccgctggacgccatacgggagatcctagtcgacgagaaagactttcagccatcacctgacttaatcccgccagggccagacgtgcagcaacagcagcacctgtttgagacaagggcactggataccttaaagggagatgaagaggctggagccgaggcacctccaaaggaagaggtcgtgccgggtgacgtgcggtcaaccctgtggctgtttgagacaaagccactggatgcctttagggacaaagtgcaagtaggccacctgcagcgagttgatccacaggacggtgaaggccatctctcaagcgatagcagctcagcgctccctttcagccagtccgccccacagcgagacgagctcaagggggacgtcaagacattcaaaaatctattcgagaccctcccacttgattctatcgggcaaggggaggtcttggcgcatgggagcccgagcagagaagaggggacagacagcgcaggtcaggcccaagggattggaagtcctgtttacgcgatgcaggacagcaaaggcaggctgcacgctctcacctctgtgagtcgtgaacagattgtgggtggcgacgtccagggctaccgatggatgttcgaaacacagccactggaccagttaggccgaagtccaagcactatcgacgtcgtacggggaataactaggcaagaggtggtagccggagatgtcggaacagcaagatggctatttgagacacagccgctggaaatgatccatcaaagggagcagcaggaacgccagaaagaggaaggaaaaagccagggtgatcctcaaccagaggcgcctcccaaaggagacgtacagacgatacggtggctctttgaaacctgcccaatgagcgaactggccgagaaacaggggagtgaggttactgatccaaccgccaaggccgaggcgcagtcctgtacctggatgtttaagccccagcctgtggatagacctgtgggctcccgtgagcagcatctacaggtgagtcaggtaccagcgggtgagcgccagactgatagacacgttttcgaaacagagcccctccaagcctctggcaggccatgcggaaggagacctgtccggtactgttcgagggtggagatcccatctggacaggtttctaggcagaaggaggtgttccaagctctggaggctggcaaaaaagaggaacaggagcctagggtcattgcaggcagcatccccgcaggctccgtgcacaagttcacatggctttttgagaattgtccaatgggatcactggcagcagagagcatccaggggggaaacctgctggaagaacaacctatgagtccatctggtaacaggatgcaggagagccaggagaccgctgccgaaggcacgctccggaccctgcatgccactcccggaatactccatcacggcggaatcttgatggaggctcgagggccaggagagctgtgcttggctaagtacgttctgtccggcacagggcaaggtcacccctacatacgcaaggaagaactggtgtctggagaactgcctcggatcatatgccaggttctacgaagacctgacgtcgatcagcagggacttctagttcaagaagaccccacaggacagctccagcttaaaccactgcggctacccacccccggaagcagtggcaacatcgaggacatggaccccgagctgcagcagcttctcgcatgtgggctgggaacatctgttgctcggacaggcctggtcatgcaagaaacagagcagggactggtcgcacttacagcatattctctgcagcctaggttaactagcaaggcttctgaacggagctccgttcagctcctggcatcctgcatcgacaaaggcgacttgtcaggtctccattcactccgctgggaaccccctgctgatccaagccccgtcccagcgtcagaaggggctcagtcacttcacccaacagaatccatcatccacgttcctcctctagacccttctatggggatgggtcatctgcgggcatccggtgccacgccctgcccaccccaagctattggaaaggcagttcctctggccggagaggcggctgcgccagcccagcttcagaacacagagaagcaggaagatagtcatagcgggcagaaagggatggccgtgctaggaaaaagtgagggcgctaccacaactcccccaggacctggcgcacccgacctcttagccgcaatgcaatctcttcgcatggcaaccgccgaggctcaatctctgcaccagcaggtgctgaataaacacaagcagggtcctacaccaaccgcaacatccaaccctatccaggacgggctgaggaaggctggcgctacacagtctaacatcaggccgggagggggatccgaccctcggattccagcagcccctagaaaactgctgtag

SEQ ID NO: 55939 - DNA, 1581 bp, Artificial Sequence
  Description of Artificial Sequence: Synthetic coding sequence
atgccccctaagaagaagccacaactgccccctaagccagcccacttaactcagagccacccaccgcaaagattacccaagccgttaccgttaagccccagctttagtagcgaggtaggccagagggaacatcagcgcggagaaagagacaccgctattcctcagcctgccaaggtaccgaccactgtggatcagggacatattcccctcgcaaggtgcccttctggccattcacagccttcactgcaacacggattgagtactaccgccccacgacccaccaaaaatcaggcaaccggcagtaacgcacagtcctccgagccaccaaaactgaacgcactcaatcacgatccgacgtcaccccagtgggggcctggcccatccggcgagcaaccaatggagggctctcaccagggagcccctgagagtcccgattcccttcaaaggaaccagaaggaactccagggccttctaaaccaggtgcaggcactcgagaaagaagcagcatcatccgtggacgttcaagcgctgcgcaggctgttcgaggccgttccccagctgggtggagcggcacctcaggctccggctgcacatcagaagcccgaagccagcgtcgaacaggccttcggcgaacttacacgtgtatctactgaggtcgcgcagctgaaagaacagaccctggctcgcctgctggatatagaggaggcagtgcataaggccctcagcagcatgtccagtctccagcctgaagctagtgctcgaggccactttcagggccctcccaaagaccatagcgctcacaagatttctgtgactgtttcgtcaagcgcgagaccctccggaagcggacaggaagttgggggtcagacggccgtgaaaaaccaggctaaagtggaatgtcacacagaggcgcagtcacaggtaaaaattagaaaccatacagaggctcgcggacataccgcctccacagcgccttcaaccagacgccaggagacctccagagaatatttgtgccctcctcgggttttaccatcctcacgggactcgccctccagccctacatttatctcaattcagagcgccactaggaagcccctggaaactccctcatttaaagggaaccccgatgtgagcgtcaagtcaacgcagttggcacaggatataggccaggccctattgcatcagaaaggagtacaagataaaacgggcaagaaagatattacacaatgctccgtgcagcccgaacctgcacctccaagtgcaagcccgctgcctaggggctggcagaaatccgtgctggagctccagactggtccagggagttcacagcattatggtgccatgaggacagtcaccgagcagtacgaggaagttgaccaattcgggaataccgttctgatgtcttctacgaccgtgacagagcaggctgagccaccaagaaatccaggatcccatttgggcctccacgcttcgccgctgttaagacagttcctgcattcccccgcaggcttcagctctgatcttacagaggctgagacagtgcaggttagctgtagttattcacagcctgctgcacagtag

SEQ ID NO: 55940 - DNA, 1953 bp, Artificial Sequence
  Description of Artificial Sequence: Synthetic coding sequence
atggcagcaaaaagcgacggccgtttaaagatgaagaagagttccgacgtggcctttactccgctccagaatagcgaccacagtggcagcgtccagggccttgccccagggctgccgtccggttccggcgctgaggatgaggaggccgctgggggagggtgctgtcctgatgggggaggctgttcacgttgttgttgttgttgtgcaggctccggcggtagcgcaggcagcggcggatcgggaggcgtggctggacccggaggcggaggggctggctccgctgccctatgcctgagattaggaagggaacagcgacgctacagtttgtgggactgcctctggatactcgcggctgtggcagtatattttgccgacgtgggcacagatgtgtggctggcggtcgactattacctccgaggtcagcggtggtggtttggccttacgttattctttgtcgttctcggttctttgtcggttcaggtgtttagcttcagatggtttgtgcatgacttctccactgaagactccgccacagcagctgccgctagctcatgccctcaacccggtgccgattgcaagactgtcgtggggggtggctcagctgccggtgagggcgaggccaggccatctacacctcagagacaagcctctaatgccagcaaatcaaacattgctgctgctaactctgggtctaactctagtggggctactcgagcttctggcaagcatcgctcagcttcctgcagtttctgcatctggcttctgcagtcacttatccatatcttacagctaggccagatttggcgctacttccataccatttatctggggatccgaagcaggcagtccggagagaatgaccggtggcgtttctactggaagatggtgtacgaatacgccgatgtgagcatgcttcacctgcttgccacatttctcgaaagtgcccctcagctggtcctgcagttgtgcattatcgtgcagactcactctcttcaggccctgcagggcttcactgctgctgcatcactggttagtctggcttgggccctcgcatcctatcagaaggctcttagggatagtcgtgatgacaaaaagccaatatcatacatggcggtcatcatccagttttgctggcacttttttaccatcgccgcaagggtcatcacctttgccctgtttgccagcgtgttccaactgtactttgggatttttattgtcctgcattggtgcataatgacgttctggatagtgcactgcgagaccgagttttgtattaccaagtgggaagaaattgtgttcgatatggtagtgggtattatttacatcttctcatggttcaatgtaaaagagggtaggactcgctgtcgcctctttatttactactttgtcatcctgctggagaatactgctctgagtgcgctctggtacctgtacaaggctccccagattgccgacgcttttgcaattcccgctctgtgcgtggtgtttagcagctttctgactggggtggtgtttatgctgatgtactatgcattcttccacccaaacggccctcggttcggccagagtccctcatgtgcatgtgaggacccagcggcagcctttaccctccccccagatgtcgctacatctaccttgcgaagcatcagcaacaatcgtagcgtcgtttcagaccgcgaccagaagtttgcagaacgcgacggatgcgtcccggtgtttcaagtgaggcccaccgctccatctacaccctccagtcggccaccccgtatcgaggagtcagttatcaaaatcgacctgttccgcaacagataccccgcttgggagagacatgtcctggaccgcagcctgagaaaggctattttagcgtttgagtgctccccatctccacccaggctccagtacaaagatgatgcacttattcaggagcggttggaatatgagacaacactctag

SEQ ID NO: 55941 - DNA, 1953 bp, Artificial Sequence
  Description of Artificial Sequence: Synthetic coding sequence
atggccgctaagtctgatgggcgactcaaaatgaaaaaatcttcagacgtagcctttacacctctccagaattctgatcacagtggaagcgtgcagggattagctccgggtttgcccagcggtagtggcgctgaggacgaggaggcagccggaggtggctgctgtcctgatggcggagggtgttctcgttgttgttgctgttgcgccggatccgggggaagtgcaggtagcgggggtagcggcggagttgcgggaccgggtggaggcggtgcaggttccgcggcactgtgtctgaggctgggaagggaacaacgtcgctattcgttatgggactgcctgtggatcctggcagctgtggcagtgtacttcgctgatgtgggcacggatgtgtggttggctgttgattactatcttcgtggacagcgttggtggtttggcctgactctgttcttcgtcgtgctgggaagtctaagtgtccaggtcttctcattcagatggttcgtccacgacttcagtaccgaagatagcgcgactgcagccgcagcgagctcttgtccgcaaccaggcgcagactgcaaaaccgtggtgggcggagggagcgccgcaggggagggtgaggccaggccaagtacacctcagagacaggcctcaaacgcaagcaagagcaacattgccgctgccaactccggaagtaactcttcaggcgctacacgcgcttccggaaaacacaggagcgcgtcttgttcattctgcatctggttgctgcagtcccttatacacatcttgcagctgggccagatctggaggtatttccatacaatttaccttggaatcagaagccgccagagtggagagaatgatcggtggagattttattggaagatggtctatgagtacgccgatgttagcatgctgcatctcctggccacattcctggagtctgcacctcaattagtcctgcagctgtgtattatcgtacagacgcatagcctgcaggctcttcaagggtttactgctgcagcgtcactggtaagcttagcctgggcccttgctagttatcagaaggccctgagagacagccgcgatgataagaagcccattagctatatggccgtgatcattcagttttgttggcacttctttactatagctgcacgcgtgattacctttgctctgtttgcctctgtgtttcagctctacttcggcatattcatcgtcttgcactggtgtataatgacattctggatcgtgcactgtgagacagaattctgcataactaagtgggaagagatcgtgtttgacatggttgtcggcattatctacatcttttcttggtttaatgtgaaagaagggaggacacgctgcagactcttcatctattattttgttatattgctagaaaataccgcactgagtgctctatggtacctttataaggcgccacagattgctgatgcattcgctatacccgcactgtgcgttgtgttttcatccttccttaccggcgttgtcttcatgctgatgtattacgcttttttccaccctaacggcccaaggtttggacagagcccctcatgtgcgtgcgaggaccccgctgcagcgtttacattacctcccgacgtggccacttcgacactgcgctccatctcaaataatagaagcgtggtgagtgatcgagatcaaaagttcgcagagagggatggatgtgtccctgtgttccaggtgaggcccactgcccctagcacaccgagctctcggcctcctcgaatcgaggagtctgtcattaaaatcgacctgttcagaaacaggtatcctgcctgggaacgacacgtgttggataggagccttcgtaaggccattcttgcctttgaatgttcgccaagtcccccacgcttgcaatacaaggacgacgcattgattcaggagcggctcgagtatgaaaccaccctttag

SEQ ID NO: 55942 - DNA, 1089 bp, Artificial Sequence
  Description of Artificial Sequence: Synthetic coding sequence
atgatgtacgaatatgccgatgtcaatatgctgcggctcctggagacatttctggagtctgcaccacagttggtcctccagctctacatcatgctacagaagaattctgcggagactctgccttgtgtctcttcagtgacctccttgatgagtctcgcctgggtcctcgcttcttaccacaagctgctgcgggattctcgggacgacaaaaaatctatgtcctaccgtggtgctataattcaggtattctggcgtctctttacgataagttcaagagtgataagttttgccctgttcgccagcatttttcagctgtatttcggtatttttgtcgtcgtacactggtgcgccatggccttttggataatccacgggggtaccgacttttgtatgagcaagtgggaggaaatcctgttcaacatggtagtgggcatcgtctatattttttgttggttcaatgtgaaagaaggtcgcacccgctacagaatgtttgcctattatacaatcgtgttaacagaaaacgcggcactgacattcctttggtatttctatcgtgatccggaaacaaccgacagttatgccgtgcccgctctatgttgcgtgtttatctctttcgtggcgggaatcgcaatgatgctcctctactatggcgttttgcatcctaccggcccacgagccaagatcctcgcctcatcatgctgcgccgagctactgtggggaattcccctcccaccagatgtggagcccatggcaccggaaattccaggctaccggggaacccaggtgacccctactcgcgcagtcactgaacaacaggaagatctaaccgccgacacatgtctgccagtcttccaggtcagacctatggggccacccacccctctgggtcgtccttacctgcctgagggcccactcattaagatcgatatgcctcgcaaacgttatccagcttgggatgctcacttcgtggaccgaagattacgaagaactattaacatcctacagtacgtgaccccgaccgccgtagggatacgctatagggacgggcctttgctgtacgaactgctgcaatacgagtcctctctctag

SEQ ID NO: 55943 - DNA, 1926 bp, Artificial Sequence
  Description of Artificial Sequence: Synthetic coding sequence
atggccgcaaaatcggatggcggaggtgtaggcgtgggattcgctcagcttcacaatcttgacgaggctgtgggttctgggggtgaagaagatggggagccaggcggtggcggatgcgggggaggcggagacggcagcgaaccgggagagtctagctcaatgcacatctgtcattgctgtaacacctcctcctgctattggggatgcagatcagcctgcctgaggtccttgctgggacggaaacctcggaggtcagctgccgctgatggcggagaccagcccttgcagccgccagcagcaccaggcgcaggcagacagccgcctaccccctcagccgcaagacccgagccgccaccacctcaggttgagcggccatggctggactgcttgtggattgtgttggcactgcttgttttcttcggcgacgtaggaactgatctatggctagccctggattactatcgaaaaggggattatgtctacttcggcctcacactgtttttcgtgctcgtgccgtccttgctcgttcagtcactttctttccgctggtttgtccaggactacacaggaggcggattgggggcagtcgagggcctcacttccagggggccacctatgatgggagcaggatatgtgcatggagcagcaagaggcggaccgggtgttcgggtaagcccgacaccaggggcacagcggctctgtcgcctgtcagtgtggatttggcagtcagttatccatctactccagatgggccaggtctggcgttacattaggacaatgtatctgggcatacagagtcagagacggaaggaacaccagaggcggttttattgggctatgatgtacgagtatgccgacgtcaatatgcttaggctcttagaaactttcctcgaaagcgccccacaactagtgttgcagctatacattatgttgcagaagaattccgctgaaacacttccctgcgtttcgagcgtcacgtccctcatgtccctagcctgggttttggccagctaccataagttgcttagagactctcgcgatgataaaaagagcatgtcctacaggggggctattatccaggtgttttggagattgttcaccatctcctccagggttattagcttcgctctctttgcctccatcttccaactttactttggcatcttcgtggtcgtgcactggtgtgcaatggccttctggatcattcacggcggtaccgatttttgcatgtccaagtgggaggaaattcttttcaatatggttgttgggattgtttatatcttttgctggttcaacgtgaaagaaggcagaacccggtacaggatgtttgcttactacacaattgtgctgaccgagaatgcagcactgacctttttgtggtacttctacagagatccagagactactgactcctatgctgttcccgcactgtgctgtgtatttatttcctttgttgccggaattgccatgatgctgttatactatggcgtgctgcatcccacaggaccaagagccaagatcctggcatcaagctgctgtgcagagttgctctggggcatacccttacctccggatgtggagccaatggctcccgagatccctgggtatagaggaacccaggtgacacccactcgtgcagtgaccgaacagcaggaagacttgaccgccgacacctgtttgccagtttttcaggtccggccaatgggtccccctaccccactcggaaggccatacctcccagaagggccactcatcaaaattgacatgcccaggaaacgctacccagcatgggatgcccatttcgttgatagaagactgcgacgcactatcaacatcctccagtatgttacacctacagccgtaggcatacgatatcgagacgggcctttactgtatgaattactgcaatacgagtcctccttgtag

SEQ ID NO: 55944 - DNA, 2034 bp, Artificial Sequence
  Description of Artificial Sequence: Synthetic coding sequence
atgttgagcagtacggatttcacattcgcatcctgggaactggttgtgagagtggaccacccaaatgaggaacagcagaaagatgtgactttgcgcgtatccggcgacctgcatgtgggaggggtaatgttgaagctggtcgagcagatcaatatatcccaggattggagcgatttcgctctttggtgggagcagaagcactgctggttgttgaagacccattggaccctggacaaatatggcgtccaggccgacgcaaagttgctgttcacaccccaacacaaaatgctgaggttacgattgcccaaccttaaaatggtccgtctcagagtgtctttctcagcagttgtgtttaaggccgtgtctgacatttgtaaaattctgaatatcaggcggtcggaggagctatccctgctgaagcctagcggcgattacttcaagaagaagaaaaagaaggataagaataacaaagaacctattattgaggatatcctgaaccttgaatcttcgcctacagcctccgggtcgtccgtctcaccagggttgtactctaagacaatgactcccatctacgacccaataaacggtactcctgcttcgtccactatgacctggttctctgattctccgctgaccgagcagaattgtagcatcttagcctttagtcagccaccccagagcccggaagcccttgccgacatgtaccagcccagaagtctggtggacaaggcaaaactgaacgccggttggttagattccagtcgttcattaatggaacaaggaatccaggaagatgagcagctactactgaggttcaagtattatagttttttcgacttaaaccctaaatatgacgcggtaaggatcaaccaattatacgaacaggctcggtgggcaatactcctcgaagagatcgactgcaccgaggaggagatgctcatattcgccgctctgcagtaccatatctcgaagctcagtttatccgccgaaactcaagacttcgctggtgagagcgaagtggacgagattgaagctgctctgtcaaacctggaggtgacccttgaggggggaaaggctgactctctgctggaggacataactgatatcccgaaactcgccgacaatttgaaattgtttagacccaagaagttgctgcccaaagctttcaagcagtattggtttattttcaaagacacgtccattgcctacttcaaaaataaagaacttgagcagggcgagcctctagaaaagcttaatctgcgcggatgtgaggtcgtgccggatgtaaacgtggccggacggaagttcggcattaagctgctgatccctgttgccgatgggatgaacgagatgtacctcaggtgcgatcacgaaaaccaatacgcacaatggatggcagcttgtatgctggcgagcaaaggaaaaacaatggccgactccagctaccaacctgaggtgctaaacatcctttcctttctgcggatgaagaatagaaattccgccagccaggtagcaagctcactggagaatatggacatgaaccctgagtgttttgtgagccctcgttgtgcaaaaagacacaagagcaaacagctcgcagccagaatacttgaagctcaccagaacgtggcccaaatgccactagtagaggctaaactgaggttcatccaagcgtggcagtccctgccagaattcggtctgacatattacctggtgcgctttaaggggagcaaaaaggacgatattctcggagtgagttataatcggctgattaagattgacgcagctacaggcatcccagtgaccacttggagattcaccaatataaagcagtggaatgtgaattgggagacacgccaggtggtgatcgaatttgaccaaaacgtgttcacagccttcacctgcctatctgctgactgtaaaatcgtccacgagtatatcggcggttacatctttctgagcacaagatcgaaggaccagaacgaaacactggacgaagacctgttccataaacttacaggtgggcaagactag

SEQ ID NO: 55945 - DNA, 1188 bp, Artificial Sequence
  Description of Artificial Sequence: Synthetic coding sequence
atgccttggagctctcgaggtgccctgttgcgtgacctagtgctgggggtgcttgggaccgccgcatttctgctggacctggggaccgatttatgggccgctgttcagtatgccctcggcggaaggtatctgtgggctgccttagtgctcgcactgctcgggctcgcttccgttgcacttcagctgttttcatggctgtggctgcgggcagatcctgctggcttgcatggctctcagccgcctagacgctgcctcgccttgctccatcttttacagctgggttacctgtaccggtgtgtacaggaactgagacaaggactgcttgtatggcagcaggaggaaccatccgagtttgaccttgcttatgccgacttcctggcgctggacatctctatgctgcggctgtttgagacttttctcgaaaccgcgcctcagctgaccctggttctagctatcatgctgcagagcggacgggcagaatattatcagtgggtggggatctgtacaagcttcctgggaattagctgggccctgttggattatcaccgggcactgaggacctgcttgccctccaagccactactcggcttgggatcatcggtgatctactttctatggaacctcctgctgttgtggccccgagtattggccgtcgctctattctcagccctctttccaagctacgtagccctgcatttcctgggattgtggttggtgctgctgctatgggtctggcttcagggcaccgactttatgccagatccatcatccgaatggctctaccgagttacagtagcaactatcctgtatttctcatggttcaatgtagcagaaggtaggacccggggaagggcaatcattcacttcgcgtttctcctgtcagactctatcttactggtggcgacttgggtcacccattctagttggttgccttctggcatccctctacagctgtggctccccgttggctgcgggtgttttttcctaggcctagccctgaggttagtttattatcattggctgcacccctcttgctgctggaagcctgaccccgaccaggttgacggcgcacgctcccttctctctccagagggttatcagctgccccagaatagacggatgacccacttagcccagaagttttttccgaaggcaaaagacgaagctgcgagtcccgtcaagggatag

SEQ ID NO: 55946 - DNA, 1122 bp, Artificial Sequence
  Description of Artificial Sequence: Synthetic coding sequence
atgaagtacacgaaacagaacttcatgatgagcgttttgggtataatcatatatgtgacggatctgattgtcgatatctgggtgtcagtacgattcttccatgagggccagtacgtcttcagcgccttggccctcagtttcatgttatttggcaccctcgtggcacaatgcttctcttattcatggtttaaggctgacctgaagaaggcaggtcaggaatcacagcactgtttcctgctcctacactgtctgcaggggggtgtcttcacaaggtactggttcgccctaaaacgcggatatcacgccgcatttaagtatgattccaacacatccaatttcgtggaggaacaaatagatctgcataaggaagtaatcgatcgggtgaccgatctcagcatgctgcgactgttcgaaacataccttgaagggtgcccccagctgatcctgcagctgtatattttgctagagcacgggcaggctaattttagtcagtatgctgctattatggtgtcctgctgtgcaatttcttggagcacagtggattatcaggtggccctgcgaaagtccctccccgataagaaacttttgaacgggctgtgccccaaaattacgtacctgttctacaagctgtttacactcttgtcctggatgctgagtgtggtcctcttgctctttctgaacgttaagattgcactcttcctccttttgttcctatggctattgggtataatctgggcttttaaaaataatactcagttttgtacgtgtatcagcatggagtttttgtaccggattgtcgtcgggttcattctcatattcacctttttcaatattaaggggcaaaataccaagtgccccatgagctgctactatattgtgcgcgtcttaggcactctcgggattctgactgtgttttgggtgtgccccctcacaatcttcaatcctgattacttcataccgatctcaatcactatagtgctcacactcttgctcggcattttatttttgattgtgtactacggttcttttcaccccaatcgatctgccgagacaaagtgcgacgaaatcgacggaaagcccgtgctgcgcgaatgcaggatgagatattttctgatggagtag

SEQ ID NO: 55947 - DNA, 1122 bp, Artificial Sequence
  Description of Artificial Sequence: Synthetic coding sequence
atgaagtacaccaagcagaattttatgatgagtgtcttgggaattattatctacgtgactgacctaattgttgacatttgggtgagcgtgcggtttttccacgagggccagtacgtgttctcggcactcgctctgagtttcatgttattcggtactctagtcgcccaatgcttcagctactcatggtttaaggccgacctgaaaaaggcaggccaggaatcccagcactgttttctgctgctgcattgtcttcagggcggtgtattcactcggtactggtttgctctcaagaggggatatcacgccgcatttaagtacgactcaaatacatcgaactttgtggaggaacagattgacctccacaaggaagtcatcgatagggttacagacttgtctatgctgcgcttgttcgagacctatctggagggatgtccccagctgattctgcaactgtacatcctcctcgaacatgggcaagcgaatttctcgcagtacgccgctatcatggtatcttgttgtgcaatcagctggagtacagttgattaccaggtagccttgcgcaagagcctccccgacaagaagttgctgaacgggctgtgtccaaaaattacgtacctgttttacaagctgttcacactgctctcctggatgctgagtgttgtgctgctgctgtttctgaacgtgaagatcgccctctttctcttattatttctttggctgttggggattatttgggcttttaaaaacaacacccagttttgcacctgtatctccatggaatttttgtatcggatcgttgtcgggttcattctgatatttaccttctttaatattaaggggcagaacaccaaatgtccgatgtcctgttactacattgtaagagtgctgggaacacttgggatactaactgtcttctgggtctgtccgcttacaattttcaatcctgattatttcatccctatttctataacaattgtgctgactctcctcctcggaatccttttcttaattgtgtactacggctcgttccaccctaaccggtcagcagagactaagtgtgatgagatcgatggcaaacccgtgctgagagagtgccgcatgcgatatttcttaatggagtag

SEQ ID NO: 55948 - DNA, 1182 bp, Artificial Sequence
  Description of Artificial Sequence: Synthetic coding sequence
atgggactactcaggggcggtttgccctgcgcccgagcaatggccagactaggggcagtccgatcccattactgcgccttgttactggcagctgccctagctgtttgtgccttttattatctcggctcagggcgagagacattttcgtcggccacaaaacggcttaaagaggcaagagctggagcaccagctgcaccatcaccacctgctttggaattagcccgtgggtccgtcgccccagcaccaggcgctaaagctaaatcattggagggcggtggtgccggtcccgtcgactatcatttgttgatgatgtttactaaagccgaacacaatgcagctctgcaggccaaggcaagagtggccctgaggtcactgctgagactggccaaatttgaggcacatgaggttctcaacttgcacttcgtgtccgaggaggcttctcgggaggtggccaaaggtctgctgcgcgaactgcttccccctgccgctggcttcaagtgcaaagtcatttttcatgatgtggcagtgctcacggataaactgttccccatcgtcgaggcgatgcagaagcactttagtgcaggtctgggaacatactacagtgattcaatctttttcttaagtgtcgctatgcatcagattatgccaaaagaaatcctacagattatccaattagacctggatctgaaattcaaaactaatattcgcgagcttttcgaggagttcgactcctttctgcctggggctatcattggaatagcacgtgaaatgcagccagtatatagacacaccttttggcagttccggcatgagaacccacagacaagagtgggcggaccgcctccggagggacttccaggatttaacagcggcgtcatgcttttaaacctggaggcaatgaggcagagccccctgtattctagactccttgaaccggcacaggtgcagcagctcgctgacaaataccactttcgcggtcacctcggtgaccaagacttctttactatgatcggcatggagcaccccaagctgtttcacgttcttgactgcacctggaaccggcagttatgcacatggtggagagatcacggatatagcgacgtttttgaggcctatttcagatgtgagggccatgtcaaaatttaccacggaaactgtaacacacccatccccgaggactag

SEQ ID NO: 55949 - DNA, 573 bp, Artificial Sequence
  Description of Artificial Sequence: Synthetic coding sequence
atgtggccacctagatgcaaagatccaggacgacaatctgcagaaatcttgcagatcattcagctcgatctggacctcaaatttaaaactaatatacgcgaactgtttgaagaattcgactcgtttttacccggtgccatcatcggcattgcacgggaaatgcagccagtctaccgccacactttctggcagttcaggcacgaaaatccgcagacccgtgtgggcggtccccctcccgagggactgcctggattcaatagcggcgtaatgctgttaaatttggaagcaatgcggcagtcacccctctactctagactccttgagccggcacaggttcagcagctggccgacaagtaccatttccgcggacatctgggggaccaagacttttttaccatgatcgggatggagcacccaaaattattccacgtactcgattgtacctggaaccggcagctgtgcacatggtggcgcgaccatggctatagcgatgtgtttgaggcttacttccgctgcgaaggacacgtgaagatttatcacggtaactgcaatacacccatccccgaagattag

SEQ ID NO: 55950 - DNA, 564 bp, Artificial Sequence
  Description of Artificial Sequence: Synthetic coding sequence
atgaacggcatgagtgtgctcatgaaggagacactaaaaagctcagtcaccccttctccttacgaggagacaggagagagacagccgtcggtcaattgggctgtctctcctcatcagacacagaatcaatgggcaagatggtcctggacttcccagcctttagaactacacacattctggcagtttcggcatgagaacccgcagaccagagtggggggtccccctcccgaagggctacccggattcaatagcggagtgatgttgctgaatttggaggcaatgcgccagagcccattgtactctcgccttctggagcccgctcaggtccagcagctagcagataaataccactttcgagggcatttaggcgaccaggacttctttactatgatcggtatggagcaccctaaacttttccacgtgctggattgtacctggaacaggcagctgtgtacatggtggagagaccacggatacagcgatgtgttcgaagcatacttcaggtgcgaaggccacgtgaaaatatatcacggaaactgtaatacaccaattcctgaggattag

SEQ ID NO: 55951 - DNA, 573 bp, Artificial Sequence
  Description of Artificial Sequence: Synthetic coding sequence
atgtggccccctcggtgtaaggacccagggagacagagcgcagaaatcttacagatcattcagctggacctagacctcaagttcaagacaaacatcagggaactctttgaggaatttgatagctttcttccaggtgccatcattgggatcgccagagagatgcagccagtgtacagacacaccttttggcagttcagacatgagaatccacagactcgagtgggagggcctccgccagaagggctccccggattcaatagtggagtgatgctactgaatttggaggccatgcggcagtcaccgctgtactcacggctgctagagcctgcgcaggtgcagcagttggccgataaatatcactttcggggacacctgggggatcaggattttttcacaatgattggcatggagcaccccaagttatttcacgttctggactgtacctggaacaggcaactttgcacgtggtggcgggaccatggatatagcgacgtcttcgaagcttatttccgctgcgagggacacgtgaaaatctatcatggaaactgtaatactcccatccccgaagattag

SEQ ID NO: 55952 - DNA, 570 bp, Artificial Sequence
  Description of Artificial Sequence: Synthetic coding sequence
atggtcaggtgcgtacctagcgctgttatcgtctgctttctgcgaccgcctcagccaggccgtacagtgatatttcatgacgttgccgtgttgaccgacaaactgtttcctatcgttgaagcaatgcagaagcatttttcagccggactaggcacttactactccgacagcattttctttttgtccgtagccatgcaccagatcatgccaaaggagatcctgcagattatacagctggacctggacctcaaatttaaaacaaacatccgagaactttttgaggagtttgactccttcctcccaggcgctatcatcggtatcgctagggagatgcagcaactggcagataagtaccacttcaggggacacctcggggatcaggacttttttaccatgataggaatggaacaccctaaactgttccacgtgctggactgcacctggaacaggcagctttgtacctggtggcgtgaccatgggtattcggacgtttttgaagcctactttaggtgtgagggccatgtgaaaatctaccatggcaactgcaacacaccaatcccggaggactag

SEQ ID NO: 55953 - DNA, 504 bp, Artificial Sequence
  Description of Artificial Sequence: Synthetic coding sequence
atgtccctggtgataaggaacttacagagagtcatccccattagacgggcacctctgcgatcaaagatagaaattgtccgccgaatcctcggagtgcagaagttcgatctggggatcatttgcgttgacaacaagaatatccagcacataaatcgaatataccgagatcgtaacgtgcccaccgacgttctctcattcccctttcatgagcatctaaaggccggagaattccctcagccggactttcccgatgactacaatctgggcgacatcttcctgggagtggaatatatctttcaccagtgtaaagagaacgaagactataacgatgtccttactgtgaccgctacccatggcctgtgccaccttctgggcttcacacatgggactgaggcagaatggcagcagatgtttcaaaaagaaaaggcagtgctagacgagctgggccgacgaaccggcacaagactgcaacctctgaccagggggctgtttggcggttcctag

SEQ ID NO: 55954 - DNA, 375 bp, Artificial Sequence
  Description of Artificial Sequence: Synthetic coding sequence
atgtcacttgtgatccgcaatcttcagcgagtcatccctattagaagagcccctttgcgaagtaaaattgaaatcgtgcggcgtattctgggcgtgcagaaattcgacctgggaatcatatgtgtagataacaagaatatacagcacatcaataggatataccgggataggaatgtacccaccgatgtgcttagttttccgtttcacgaggtgactgcgacccacggcctgtgccatctgttagggttcactcatggcacagaggccgaatggcagcagatgttccaaaaggaaaaagcagtgctcgacgagcttggcaggcgtacaggaacccgcttacaacccctgaccagggggctgttcgggggtagctag

SEQ ID NO: 55955 - DNA, 504 bp, Artificial Sequence
  Description of Artificial Sequence: Synthetic coding sequence
atgagcttagtaatccggaatctacaacgagtgatccccatcagaagagcccctctgcgcagcaaaatcgagatagtacgacggatcctcggcgtgcagaaatttgacttggggattatttgcgtggataataagaacattcagcacataaaccgcatttatcgtgaccgaaatgtccccacagacgtcctgagctttccattccatgagcatcttaaagccggagaattccctcagcccgattttcctgatgactataacctgggcgatattttcctaggggtcgagtatatattccaccagtgtaaggaaaatgaggattacaatgacgtactcactgtgaccgccacccacggcctttgccacctgctgggatttacgcacgggaccgaggccgagtggcaacagatgtttcagaaggaaaaagcagtgctcgatgagttggggaggaggaccggaaccagattacaaccattgactagaggcctgttcgggggtagctag

SEQ ID NO: 55956 - DNA, 240 bp, Artificial Sequence
  Description of Artificial Sequence: Synthetic coding sequence
atgtccctggtgatccgtaatcttcagagggtgatcccgatcaggcgtgcgccactccggtcaaaaatcgagatcgttaccgcaacccacgggctgtgccatctgcttgggtttacccatggcactgaggccgaatggcagcaaatgttccagaaggaaaaagcggtcttagatgaattagggaggagaacgggtacccgtttacaacccttgacaagaggcctcttcggcggaagttag

SEQ ID NO: 55957 - DNA, 369 bp, Artificial Sequence
  Description of Artificial Sequence: Synthetic coding sequence
atgtcattagttatccgtaatttgcagcgggtgattccaatacgccgtgctcccctgaggtccaaaatcgagatccatcttaaggccggagagttcccacagcctgacttccctgatgactataatttgggtgatatattcctgggagttgaatacatttttcaccagtgcaaggagaacgaagattataatgacgtcctaacagtcacagctacacacggattatgtcatctcctcgggttcacccacgggactgaggctgagtggcagcagatgttccaaaaggagaaggcggtacttgatgaattgggtcgcaggaccgggacacgcttgcaaccactgactcgcggactttttggcggtagctag

SEQ ID NO: 55958 - DNA, 504 bp, Artificial Sequence
  Description of Artificial Sequence: Synthetic coding sequence
atgagtcttgtcatccgcaacctccagagagtaataccaattagacgcgcacccttaaggtctaaaattgaaatcgtgagacgcatattgggggtgcaaaaatttgacctcgggataatctgcgtagacaacaaaaatattcagcatattaacaggatctatcgcgatcgcaacgtgcctactgatgtgttgagctttccattccacgagcatctgaaggcgggtgaatttcctcagccggattttcccgatgactacaatttgggcgatatcttcctcggcgtagagtacatcttccaccagtgcaaagagaatgaggattacaacgatgtgcttacggtcaccgctacccacggcttatgccacttgctcggattcacccatggaaccgaggccgagtggcaacagatgttccaaaaggagaaagcagtgctggacgagctcgggagaagaacgggaaccaggctgcagccactgactcgaggtctgttcggtggctcctag

SEQ ID NO: 55959 - DNA, 921 bp, Artificial Sequence
  Description of Artificial Sequence: Synthetic coding sequence
atggcagccgttgacgatctgcagttcgaggaatttggcaacgccgcaaccagtttgacagccaaccctgatgcaacaacagtgaatatcgaggaccccggagagaccccaaagcaccagcctgggtccccccgaggatctggtagggaggaagatgatgaactactcggcaacgatgactcagacaagactgagttgctggcaggtcagaaaaaaagttccccgttctggacctttgagtattaccagaccttcttcgacgtggatacctaccaggtgttcgatcggatcaagggctctctgctgccaatccccggtaagaacttcgtcaggctgtacatccgctcaaatcccgacctttacggtccattttggatctgcgcgacgcttgtgttcgcaatcgccatttccggcaatctgtcaaattttctaatccacttgggtgagaagacgtaccactatgtccccgagtttagaaaggtctccattgctgccacaatcatatacgcctacgcgtggctcgtgcccctcgcactgtggggatttctcatgtggcggaattcgaaagtgatgaacattgtgtcctactcatttttggagatcgtgtgtgtttacggctactccctgttcatatacataccaacggctatcctgtggattatcccacagaaggccgtgagatggatcctggtgatgatagcgttaggcatcagcggcagtctgctggcaatgacattttggcccgctgttcgtgaagacaaccggcgtgtggcattagccactatcgtgacaatcgtgctgctgcacatgctgctgagtgtggggtgtttggcttacttcttcgacgcccctgagatggatcacctgcctactacaacagccacgcccaaccagactgtggcagctgctaaatctagttag

SEQ ID NO: 55960 - DNA, 372 bp, Artificial Sequence
  Description of Artificial Sequence: Synthetic coding sequence
atgtggagaaactctaaggtgatgaatatcgtaagctacagtttcctagagattgtgtgtgtttacgggtattccctgtttatctatatacctacagctattctatggatcataccgcagaaggcggtgagatggatactcgtgatgatagcactgggtatctctggcagcctcctggcgatgaccttctggcctgctgtccgcgaagataatcgaagagtggcgctggctaccattgtgactatcgtccttctacatatgctgttgagtgtgggctgcctggcctatttcttcgacgccccagaaatggaccacctgcctacaacgacagctactcccaaccagacggtagctgccgcaaagtcaagttag

SEQ ID NO: 55961 - DNA, 654 bp, Artificial Sequence
  Description of Artificial Sequence: Synthetic coding sequence
atggccgcagtagatgatctgcagttcgaagaatttggaaatgccgctacgtccctgaccgctaatcctgacgccactactgtgaacattgaggaccccggagaaacacctaaacatcagcccggaagccccagggggagcggcagggaggaagacgacgagctgcttggtaatgacgatagcgacaagaccgagcttctggccggacaaaagaagtcgtcaccattctggactttcgaatactatcagaccttcttcgacgttgacacctatcaggtcttcgacaggattaagggctctcttctgcctattcccggtaaaaattttgtccgcctctacatacgcagcaacccggatctatacggaccgttctggatctgtgcaacactggtgttcgccatcgccatttccgggaaccttagcaacttcctgattcatctcggtgagaagacctaccactatgtgcccgagttccgtaaggtcagtattgccgctaccattatatacgcctacgcctggctggtcccccttgccctttggggatttttaatgtggcggaattctaaggtgatgaatatagtctcttattcttttctcgagatcgtgtgtgtgtacggctactccctgtttatctacatccccaccgcagtttag

SEQ ID NO: 55962 - DNA, 921 bp, Artificial Sequence
  Description of Artificial Sequence: Synthetic coding sequence
atggcggcagtcgacgatctgcagtttgaggagtttggaaatgcagccacttctctgaccgctaaccccgacgcgactacggtgaatatcgaggacccgggagaaacccccaagcatcaacccggatcaccaagaggaagtgggagggaggaagatgacgagttgctgggtaatgacgacagcgataaaactgagttacttgccggtcaaaaaaagtccagccctttctggacttttgagtactaccagaccttttttgacgtggatacttatcaagtattcgaccgcatcaaaggatccctgcttcccattcctgggaaaaactttgtgcggctttacattcgctcgaatcctgatctctacggtcccttttggatctgtgccacattggttttcgcaattgcaatttccggaaatctcagcaattttctgatccacctcggcgagaagacgtatcactatgtgcccgagttccgtaaggtgagcatcgccgcaacaatcatctatgcctacgcgtggctcgtgcctctggccctgtggggcttcttaatgtggaggaactctaaggttatgaacatcgtgtcctattcttttctggaaattgtgtgcgtgtacggatatagtttgttcatttatatccctacagcaatcctctggatcatcccccagaaagctgtgcggtggatcctggtgatgatcgccctgggcattagtggtagtctgctggctatgacattttggccagctgtgcgggaggacaatcggagggtggcactggccactatcgtcaccattgtgctcctgcacatgctactgtccgtgggctgcctggcgtatttcttcgacgccccagaaatggaccacctcccgaccacaacagccacacctaaccagactgttgcagccgctaagtcctcctag

SEQ ID NO: 55963 - DNA, 996 bp, Artificial Sequence
  Description of Artificial Sequence: Synthetic coding sequence
atgagcggcggagagataagcagccggaccctacagatttttttcctcatcattgggaggaggctgacaggcaggatggctgcagttgacgaccttcagtttgaggagtttggcaatgctgccacttctctgaccgccaatcctgatgcaaccaccgtcaacatcgaggatcccggtgaaaccccaaaacaccagccaggcagccctcgtggatctggacgagaggaggacgatgagctgctaggtaacgatgactctgacaaaactgaactgctggcaggccagaaaaagagcagcccattctggaccttcgagtactatcagacgtttttcgacgtcgatacctaccaggttttcgatagaattaagggatctctcctccctattcctgggaagaattttgtcagactttatatcagaagtaatcctgacctttatggtccattttggatctgtgccaccttggtgtttgcaattgccatcagcggcaatctctccaacttcctgattcacctgggggagaagacctatcactacgttccagaattccgaaaagtaagcattgccgctaccattatctacgcatacgcgtggctcgtccctttggctctgtggggattcctgatgtggcgaaattccaaggtgatgaacattgtgagttattcattcctggaaatcgtgtgcgtgtacggatactctctctttatctatattccgactgccattctctggatcataccgcagaaagctgtgaggtggatcctcgtcatgattgcactcgggatcagtggatctctactggcgatgaccttttggcctgccgtccgggaggataacaggcgagtggcactggccacaatagttacaattgtcttgctgcacatgcttctcagcgtggggtgtctggcctacttttttgatgcccctgagatggaccaccttcctacaacgaccgccaccccaaaccagacggtcgctgccgcaaaatctagctag

SEQ ID NO: 55964 - DNA, 951 bp, Artificial Sequence
  Description of Artificial Sequence: Synthetic coding sequence
atggccagcgccgacgaattaactttccatgaattcgaggaggctaccaacctcctggccgatactccagatgctgccacaacttcgagaagcgatcagctgactcctcagggccacgtggcagtcgcagtgggttcagggggaagctacggtgccgaggatgaggttgaggaggagagtgataaagcggctctcttacaggagcaacagcagcaacaacagccaggtttttggacgttctcatactatcagagtttcttcgacgtggatacaagccaagtccttgatcggatcaaaggctcactcttgcctagacctgggcataacttcgttcggcatcacctccgcaacaggcctgacctgtacggccctttttggatctgcgccacactcgccttcgttttagctgtcaccggcaatctcacactagtgctggcccagcggagggacccctctatccactactctccacagtttcacaaagtgaccgtcgccggaattagcatctactgctacgcctggctggtgcctttggccctctggggctttctgcgctggaggaagggcgtgcaagaaaggatgggtccatatacttttctggagactgtttgcatatatggatactctttatttgtgttcataccaatggtggtgttatggctgatacccgtgccgtggcttcagtggttgttcggggcattggcgcttggtctatcagcggcaggcctcgtcttcactctttggcctgtcgtgcgagaggacactaggcttgtcgccaccgttctgctttcagttgtcgtcctgctgcacgctctcttagctatgggatgcaagctgtacttcttccagtccctgcccccagagaacgttgcccctccccctcagatcacatccttacccagtaacatcgccttgagtcctacccttcctcaatctctcgctcctagttag

SEQ ID NO: 55965 - DNA, 735 bp, Artificial Sequence
  Description of Artificial Sequence: Synthetic coding sequence
atgcagcccccaggacccccacccgcatacgccccaacaaacggtgactttacttttgttagcagtgcagatgcagaagatctgagtggatcaatcgcctctcctgatgtgaaactgaatcttggaggggatttcatcaaagaatcgactgcgactaccttcctgagacaacgtggttatggctggctgctggaagtggaagacgatgaccccgaggacaacaaaccactgctggaggaactggacatcgatctgaaagacatctactataagatccggtgtgtcctcatgccaatgccatctctcggcttcaatcgacaggtagttcgcgacaaccccgacttctggggcccattggccgttgtcctcttcttcagcatgatctcgctatacgggcagttccgtgtggtctcctggatcataaccatctggatcttcgggagtctgacaatttttctactcgcaagagttttggggggagaggtggcctacggccaagtgctcggtgtgatagggtactctttgctcccgctaattgtgatcgcacccgtgctgctggttgtaggctcttttgaagtggtgagtacactaattaaactgttcggggtgttttgggcagcgtatagcgcggcaagtctccttgtcggcgaagagtttaagacaaagaaacccctcctaatttacccaatcttcctgctgtatatatatttcctgtccctttacacaggcgtgtag

SEQ ID NO: 55966 - DNA, 582 bp, Artificial Sequence
  Description of Artificial Sequence: Synthetic coding sequence
atggccgaggcagaagagtcacccggagaccctggaaccgcctccccaagacccctgatgcgcgatttgaaggccgtgggcaaaaagttcatgcacgtcctctacccacggaagtcaaatactctgttgcgggactgggacctgtgggggccactgattctctgtgtaaccctggccctgatgttgcagcgagactccgctgatagcgaaaaggacgggggacctcagtttgccgaggtgttcgtaatcgtgtggttcggggcagtgaccattaccctcaacagcaagctactcggcggaaatatctccttttttcagtcactatgcgtactgggctactgcattctacctctgacagtcgcgatgctcatctgcagactggtcctgcttgccgaccctggcccagtcaactttatggttcgcctgttcgttgtaatcgtgatgttcgcctggtctatcgtagcttcgacagcattcctggcggacagccagccccctaatcggagggcactggccgtgtaccctgtcttcctcttctattttgttatctcatggatgattctgaccttcacacctcaatag

SEQ ID NO: 55967 - DNA, 567 bp, Artificial Sequence
  Description of Artificial Sequence: Synthetic coding sequence
atggctgaagccgaggaaagccccggagacccgggaacagcctcaccgcgaccacttatgcgggatctgaaggcagttggaaaaaagtttatgcatgtactctatccacgtaaatctaataccctgttaagggattgggatctctggggcccactgattctctgcgtcacgctggccctgatgttgcaacgggatagtgcagattcagagaaggatggaggtccccaattcgcggaagttttcgtgattgtatggttcggggctgtgaccattacgctgaattctaaactgttaggaggcaacatctcctttttccaaagcctctgcgtgctgggttattgcatcctgcctctgaccgtggctatgctgatttgtcgtctggttctgctggcagatcctggccctgttaattttatggtgcgcctgttcgtcgtcatagtcatgtttgcatggagcattgtggcctccacagctttcctggcggatagtcagcctcctaaccgcagagcccttgctgtgtacccagtttttctgttctacttcgttatttcttggatgattctgtag

SEQ ID NO: 55968 - DNA, 711 bp, Artificial Sequence
  Description of Artificial Sequence: Synthetic coding sequence
atggcggaggcagaggaaagccccggtgaccccggtacagcctcgccccgtcctctgttcgctggcctgtcagacattagcatctctcaggatatccccgtggagggagagatcacaattccaatgagatccagaatcagagagtttgacagctctaccctcaacgaaagcgtgagaaatacaattatgagagacctcaaggcagtggggaaaaagttcatgcatgtcctctatccgcgtaagtctaacactctattaagggattgggacctgtggggacccttaatcctgtgtgtcacacttgcactgatgcttcagagggactctgcagactcagagaaggatggaggtccccaatttgcagaggtcttcgtgatcgtatggtttggggctgtaacgataacgctgaactccaaattgctcggcggtaacatcagcttctttcagtctctgtgcgtcctgggatattgtatcctcccattaaccgtggccatgcttatatgtcgcctggtccttctggccgatcctggacctgtaaactttatggtgcggcttttcgtggtgattgtcatgtttgcatggtcaatcgtggcttccactgctttcttggcagactcccaaccccctaatagacgcgctcttgccgtgtaccctgtgtttctcttctatttcgtgatcagctggatgattcttacattcactcctcagtag

SEQ ID NO: 55969 - DNA, 843 bp, Artificial Sequence
  Description of Artificial Sequence: Synthetic coding sequence
atggatctgcttaagattagtcacacaaagctgcatctgcttgaggacttgtcaatcaagaataagcagagaatgtcaaatctggcccagttcgatagcgacttctatcagtctaacttcactattgacaaccaagaacagtccgggaatgatagtaatgcctatgggaacctgtacggtagtagaaagcagcaggcaggcgaacagccccagccagcatccttcgttcccagcgagatgctcatgagctctggttacgccggacagtttttccagccagcttcgaatagcgattattactctcagtccccttatatcgactcgttcgatgaagagccacctttgctggaagaattaggtatccactttgaccacatctggcagaaaactctgacagtcctcaatccaatgaagcccgtcgatggtagcattatgaatgaaacagacctgactggacctatactgttttgcgtggccctaggagccaccttgcttttggcaggtaaggttcagttcggttacgtgtatggcatgtccgcaatcggctgcttagttatccacgccctacttaacctgatgtcctcgagcggggtctcctacgggtgtgttgcctcagtactgggctattgcctgttgccaatggttatcctctctggatgcgcgatgttcttcagtttgcaaggcatcttcgggatcatgtcttcattagtcatcataggctggtgtagcctctccgcatcaaaaatctttattgccgctcttcacatggagggccagcaacttctggtggcctacccctgcgcaatcctttatggcctcttcgccctgttgacaatcttctag

SEQ ID NO: 55970 - DNA, 774 bp, Artificial Sequence
  Description of Artificial Sequence: Synthetic coding sequence
tgaatgtctaacctcgcccagttcgactctgacttctaccagtcgaactttacaatagacaatcaggagcaaagcggaaatgactccaacgcctacggcaacctgtacggatcccggaagcagcaggccggagaacaaccgcaacctgcttcatttgttccgtccgaaatgctaatgagcagtggatatgcgggacagtttttccagcccgcttctaactccgactactatagccaatcaccttatatcgactcctttgatgaggagccacccctcctcgaggaactcggcatccacttcgatcatatctggcaaaaaaccctcactgtcttgaatcctatgaagcctgtcgatggatcgataatgaatgaaaccgacctgaccggtccaattctgttctgcgtcgccctgggcgctactctgctgctggcaggcaaggtccagttcgggtacgtatatgggatgtctgccatcggttgtctcgtaattcatgccctcctcaacttgatgagctcatcaggtgtaagttacggatgtgtagcctctgtgctcgggtactgcctccttcccatggtgattctgagcgggtgtgctatgttcttcagcctccagggaatttttggaatcatgtcaagtcttgtgattattggatggtgtagcctatctgcctcaaagatcttcatcgcggcactacacatggagggccagcagctcctggtagcctatccctgtgccattctttatggcctgtttgcccttctgacgattttttag

SEQ ID NO: 55971 - DNA, 900 bp, Artificial Sequence
  Description of Artificial Sequence: Synthetic coding sequence
atgcctggatctgcctccaagcgtcggatccccgtttcccagccaggcatggccgatccacaccagctgtttgatgacactagctcagctcagtccaggggatacggggctcagcgagccccaggcggtctgtcctaccctgccgcatccccgaccccccacgcagcttttttggctgaccctgtatccaatatggccatggcatacggctcctcgctggccgcacaaggaaaagaattggtggataaaaacatcgacagatttattccgatcaccaagttgaagtactacttcgccgttgataccatgtacgttggccgaaagttgggattgttgttcttcccctaccttcatcaggattgggaagtccagtaccagcaggatacaccagtggctccccgatttgatgtgaatgcccctgacctgtatatacctgccatggctttcatcacctatgtactggtggcagggctggcactgggaacccaggaccgatttagtccggatctgcttggactgcaggccagtagcgccctggcgtggctgactctggaggtgctggccatcctactgagtctgtacctcgtgaccgtaaacaccgatctcaccaccattgatctggtggcctttctcggctataagtacgtggggatgatcggaggggtccttatgggactcctcttcgggaaaatcggctattatttagttctgggctggtgctgcgtggccatattcgtcttcatgataagaaccctgcgattgaaaattctcgcggatgctgccgctgagggtgtccccgttaggggggctcgtaaccagctcagaatgtacctcacaatggccgtggccgctgcccaaccgatgttgatgtactggctcacattccacctagttagatag

SEQ ID NO: 55972 - DNA, 876 bp, Artificial Sequence
  Description of Artificial Sequence: Synthetic coding sequence
atgcaccctgccggacttgcggctgctgccgcaggcactcccagattaccaagtaaacgtcgaatcccggtgtcccagcctggaatggcggatccgcaccagctgttcgacgatacctcaagcgctcaaagccggggttacggtgcacaaagagctccgggtggacttagctacccagccgcaagccccactcctcacgcggctttcctagccgatccggtatccaacatggctatggcctatggatcctcactggcagctcaggggaaagagctagtcgacaaaaatattgataggtttatcccaattaccaagctgaagtactatttcgccgttgatacaatgtatgtgggaaggaagttaggcctgctgttctttccctatcttcaccaggactgggaggttcagtaccaacaggacaccccagtggcgcctcgcttcgacgtgaacgcacctgatttgtacattcctgcgatggccttcatcacatacgtcttggtcgctgggctcgctctgggcacacaggatcggttcagtcccgatttactcgggctccaagcttcaagcgctctcgcctggttaaccctcgaagtcctcgccatcctgctctctctgtatctagtgactgtgaataccgacttgacgacgattgatctcgtggcctttctcggttacaagtacgttggcatgattgggggtgtgctgatgggtctcctgttcgggaagattgggtattacctggtgctaggatggtgctgtgtcgcaatcttcgtcttcatgttccctctgctgcctggcgcagtcgcccatgcctgtaatccctcgacacttgggggacgcggagggcgtattacacggagcgggagatgcgggtag

SEQ ID NO: 55973 - DNA, 945 bp, Artificial Sequence
  Description of Artificial Sequence: Synthetic coding sequence
atgcacccggctgggcttgccgcagcggctgcaggcacgcccaggttgcgaaagtggccatccaagcggagaattcccgtttcccagcctggaatggcagacccccaccagctgttcgacgatacctcttctgcccagtctcggggatacggagcgcagagagcacccggaggcctcagctatcctgcagcttccccgaccccccacgccgcattcctggccgatcctgtaagcaatatggccatggcctacgggtcctcccttgcagctcagggaaaggagctagtggacaaaaatatcgataggttcatacctatcaccaagctcaagtactacttcgccgtcgacactatgtacgttggacggaagctcggactactgttcttcccttatctgcaccaagactgggaagtccagtaccagcaggacacgcctgtagcgccacggtttgacgtaaatgcaccggatctatacattccagccatggcctttattacttatgtcctcgtcgccggactggcactcggaactcaggatagattttcccctgatctattggggctccaggcgtcctcggcactggcgtggctgacattagaggtgctggccatcctcctgagtttgtatttagtgacggtgaataccgatcttactaccatcgatttggtggcctttttgggttacaaatacgtcgggatgatcgggggtgtcttgatgggactgctgtttggaaaaataggatactatttggtgttaggctggtgctgcgtagctatcttcgtgtttatgatccggaccctgagactcaaaatcttagctgacgccgcagcagagggtgtccctgtcaggggcgctcgcaatcagttaaggatgtatttaacaatggccgtggcagccgctcagcctatgttgatgtactggctgacatttcacctcgtcaggtag

SEQ ID NO: 55974 - DNA, 852 bp, Artificial Sequence
  Description of Artificial Sequence: Synthetic coding sequence
atggccgacccccaccagctttttgacgacacctcgagcgcacagtcacgcggttatggggcacagagggctcccggtggcctgagctatccagccgcaagtccaaccccgcacgctgctttcctggcagaccccgtgtctaatatggccatggcctacggaagttcccttgcggctcagggtaaggagctggtagacaagaacattgacaggtttatcccaattacgaagctgaagtactattttgcagtagacaccatgtatgtaggcaggaagctcggcctactgttcttcccatacttgcaccaagactgggaggtacagtaccagcaggatacccccgtggcaccaaggtttgatgtcaatgcgcctgacctgtacattcctgccatggcgtttatcacgtatgtacttgttgcgggactcgcgctggggacccaggaccgatttagtccagacctactggggctccaggctagtagcgcattagcatggctgaccctggaagtgctcgccattctgctaagcttatacctagttaccgtcaacaccgatctgacgaccattgatttagtcgcctttctgggttacaaatatgtaggcatgatcggaggcgtcttgatgggcctcctattcgggaagattggatattatttggttctgggatggtgctgcgtggccattttcgtgttcatgattagaacactgcgacttaagatactggccgacgccgcagctgagggcgtcccagttcggggtgctcgtaatcagctgcggatgtaccttactatggcggtcgccgctgcgcaaccgatgctcatgtactggttgacctttcacctcgtgcgctag

SEQ ID NO: 55975 - DNA, 609 bp, Artificial Sequence
  Description of Artificial Sequence: Synthetic coding sequence
atgagtggtaggtccgtgcgggctgagacccggagcagggccaaggacgatattaaaaaggtgatggcagccatcgagaaagtgcggaaatgggaaaaaaaatgggtcactgtgggcgatactagcttaaggattttcaagtgggtccctgtgacagactcgaaggagaaggagaaaagcaaaagcaactcatctgcagctcgtgagcctaatggctttccctcagacgcaagtgctaattctagcttacttctggaatttcaggacgaaaacagcaaccaatcttccgtttccgatgtctatcagctcaaggtagactccagcacgaactcctccccctccccccaacagagcgagtcactatctcccgctcacacctcggactttaggacggacgactctcagccaccaacactcggccaagaaatcctcgaggagccatcactgccttcgagtgaggttgcggacgaaccaccaacattgaccaaagaggagcctgtccccctggaaacgcaagtggtggaagaagaggaggacagcggtgctccccctcttaagaggttctgtgtggatcagccgacagtgcctcaaaccgcgtctgaaagttag

SEQ ID NO: 55976 - DNA, 495 bp, Artificial Sequence
  Description of Artificial Sequence: Synthetic coding sequence
atgaaattgtattctctgagcgtgctctacaaaggagaggccaaagtggtgctgttgaaggctgcttatgacgtatcatccttcagcttttttcagcgctccagtgtgcaggaattcatgacctttacttctcagttgatcgtggagcgctccagcaaaggcactcgcgctagcgtaaaggaacaggactacctttgccacgtctacgtgcgtaatgattctctcgccggagttgtgattgccgacaatgagtatccatcccgtgtagcgttcacccttctggaaaaggttctcgacgaattttccaagcaggtggatagaattgactggcccgtgggctccccagcaaccattcactatcctgcccttgacggtcacttgtctcgttatcagaatccgagagaggccgacccaatgactaaggtacaggcggagctcgacgagaccaaaatcatcctggccaggaaacagaacagttgttgtgccataatgtag

SEQ ID NO: 55977 - DNA, 1119 bp, Artificial Sequence
  Description of Artificial Sequence: Synthetic coding sequence
atggcatccaatgaggacttctcaatcacacaggacctggagatccctgctgatatcgtcgaactgcacgacattaatgttgagcccttacctatggaagacatcccaaccgaaagtgtccagtacgaggatgtggacggcaattggatctatggcggtcataaccatccgccacttatggtgctccaaccactattcactaatactggctacggggaccacgatcaggaaatgttgatgctgcaaacccaggaggaagttgtgggttactgcgactcagacaatcagctaggcaatgacctagaggaccagctggctctgcccgattctattgaagacgagcatttccagatgaccctggctagcttgtctgcatcagccgcaagcaccagcaccagtacccagtcacggagtaaaaagccctccaagaaaccgtctggcaagagtgctacatcaacagaagctaatcccgctggctcttccagcagtctggggacccgcaagtgggaacagaaacaaatgcaggtgaagacactggaaggcgagttctccgtcaccatgtggtctcctaacgacaacaacgaccaaggagcggttggggaaggtcaggcagaaaacccgcctgattactccgagtacctgaaaggcaagaagctgcccccaggaggtctaccgggaattgacttgtcagatcccaagcagttggctgagtttacaaaggtaaagccaaaaagaagtaagggggagccccctaagacagttccgtgttcttacagcggctgcgagaagatgtttcgcgactatgctgcaatgcgcaagcacctgcacatccacggcccacgtgtccacgtgtgcgcggaatgcggtaaggccttccttgagtcttctaaactgcgacggcaccagctcgtgcacacgggcgaaaaacccttccaatgcacctttgaagggtgcggaaagaggttcagtctggattttaacctgcgcacccacctgcggattcacaccggcgataaaccctttgtatgtccttttgacgtttgcaatcggaaatttgcccagagcactaatctaaaaacccacattcttacacatgtcaaaactaagaacaacccgtag

SEQ ID NO: 55978 - DNA, 2301 bp, Artificial Sequence
  Description of Artificial Sequence: Synthetic coding sequence
atggcctctgatacccccgagtcactaatggctctgtgtactgatttttgtcttcgtaatctggacggtaccctggggtaccttttggataaggaaactcttaggctgcatccagacatctttctgccttcagagatttgcgaccgcctggtgaacgaatatgtggaactggtgaatgccgcatgtaattttgagccacatgagagttttttttccctgttctccgaccccagatccacacgactcactaggatccatctgagggaggacctcgtacaggaccaggatttggaagcgatccgcaagcaggacctcgtggagctgtatctcacaaattgtgagaagctgagtgcaaaatcactacagacactgcgttcatttagtcacacacttgtgtccctgtctctgttcgggtgcaccaacattttctatgaggaagaaaatcctggaggatgtgaagacgagtatctcgttaatcctacctgccaagtgcttgtgaaggactttactttcgagggattcagccgactgcgttttcttaatttgggaaggatgattgattgggtgcccgtggaatcactattgcggcctctgaatagcctggccgctctggatctgtccggaatccagacctccgatgctgcctttctgactcagtggaaggacagcctggtgagccttgtactctacaatatggacttgagcgacgatcacattcgggtgatagtacagttgcataaactacgccatttggatatatcacgggaccgcctgtcttcctattacaagttcaaactgaccagggaagtcctgtctttgttcgtgcagaagttgggcaatcttatgtcacttgatatcagcggtcatatgatcctggagaattgctccattagcaagatggaggaggaagcgggacagacaagcatcgagccgagtaagtccagtattattcctttccgggcactgaaaagaccactacagtttctgggcctgtttgagaactcactttgcaggctcacccatatacctgcgtataaggtttccggcgataagaatgaagaacaagtgctgaacgcaatagaagcttacaccgagcatcggccagaaataacttcccgagccattaatcttcttttcgacatcgcaagaatagagcgatgcaatcaacttctgagggctttgaagctcgtgattaccgcactgaaatgtcataaatacgaccggaatattcaagtgacaggatcagccgcactcttctacttaaccaatagtgagtacagatctgagcaatcggtcaagttgcgaaggcaagtgatccaggtggtgctgaacggtatggaatcataccaggaggtaactgttcagcgcaattgttgtttgacactctgcaacttcagtatccccgaggaactggagtttcagtatagacgtgtcaatgaattactgctttcaatcctaaacccaaccagacaggatgaatctatccaacgtattgcagtgcatttgtgcaatgccctggtgtgccaggtcgacaatgatcacaaggaggctgtcggtaaaatgggtttcgttgtgacgatgcttaagctgatccagaaaaaactcctggacaagacctgcgaccaggtcatggaattctcctggtcagcactgtggaacataacggacgagactccagacaattgcgagatgtttttaaatttcaatgggatgaaactattcttggactgcctgaaggaattccctgaaaagcaagaactccaccgcaatatgctgggactgctgggtaacgtggcagaggtcaaagaattgcggccacagctcatgacatcccaattcatatctgtgttcagcaacctcctggaaagcaaggctgacggaattgaagtttcctataatgcctgtggagtgctgtcacatatcatgttcgatgggccagaggcctggggggtatgtgagcctcagcgggaggaggtggaagaacggatgtgggcagccatccagtcttgggacatcaattcgagacgtaatatcaactaccggtcgttcgaacctatcctacgcctgctgccccaagggatctcacctgtgtcgcagcactgggcgacatgggccctctataacctggtatctgtttacccagataagtattgtcccctgctgatcaaagagggtgggatgcctcttctgagggacatcataaagatggccacagcccgtcaggagacgaaggagatggcccgaaaggtgatcgagcattgctctaatttcaaagaggaaaacatggatacttcacggtag

SEQ ID NO: 55979 - DNA, 498 bp, Artificial Sequence
  Description of Artificial Sequence: Synthetic coding sequence
atggctagcgatactccagagagcctgatggcgttatgcacggacttttgcctgcgcaaccttgacggcacactgggctaccttctcgacaaagagaccctgcgccttcatccagatatcttccttccctccgaaatatgcgaccgattggtgaacgagtacgtcgagctggtgaatgctgcgtgtaacttcgagcctcatgaatcatttttcagcttgttttcagaccctcgctccacaagactaacacggatacatctcagagaagatctggtccaggaccaggatttggaggcgatccggaaacaggatctcgttgagctctacctgacaaactgtgaaaaactttcggctaagtctctgcagactcttcggtcgttttctcatacgctggtctctctttccctgttcggctgtactaatatattttacgaggaggagaacccagggggttgtgaggacgaatatctcgtgaatcctacctgccaagtgctgtag

SEQ ID NO: 55980 - DNA, 306 bp, Artificial Sequence
  Description of Artificial Sequence: Synthetic coding sequence
atggcctctgacaccccagagtcgctcatggcactgtgtacagacttctgtctgcgcaacctagatggcacgctgggctatctgctagataaggaaaccctcaggttgcaccctgatatctttcttccgagtgaaatctgcgatcgtctggtcaacgaatacgtggagctcgtgaacgccgcatgtaacttcgagccccatgaaagcttttttagcctgttttcagatccgaggagtacaagacttactcggattcaccttagggaggacttggtacaagatcaggatttagaggcaattagatag

SEQ ID NO: 55981 - DNA, 1239 bp, Artificial Sequence
  Description of Artificial Sequence: Synthetic coding sequence
atgatggccttgtggtctctgctgcatctcaccttcctgggcttttcaatcactctcctgctcgtgcacggacagggattccagggaacagcggctatctggccctccttgttcaatgtgaatttgtctaagaaagtgcaggagtctatccagataccaaacaatggatctgcaccacttcttgtggatgtgcgcgtatttgtgagtaacgtcttcaacgtggatattctgaggtacacaatgtcaagtatgttacttctgcgtttaagttggttggacactagactcgcttggaatactagcgcccatcctaggcacgccatcactctgccttgggaatccctgtggacacccagactcaccatccttgaggcattgtgggttgactggagagaccagagcccacaggccagggtggaccaagatggtcacgtcaagttgaaccttgctcttgccacagagacgaattgcaacttcgagctgctgcattttcccagggaccattccaactgctccctgtcattctacgccctttctaacaccgctatggagctcgagttccaagcccatgtggttaatgagatcgtttctgtgaagagagaatacgttgtgtacgacctgaagactcaggtgcctccccagcagctcgtcccatgctttcaggttactttgcgccttaagaacaccgcccttaagtctatcattgcccttctcgtcccggctgaggcattactgctggcagacgtgtgcgggggactcttgccgttgcgggcaatcgagcgaattggttacaaagtcaccctgttgctgagctatctagtgcttcacagctctttggtccaagccctgccaagctccagttcttgtaaccctctgctgatttactacttcacaattctgttgctgctgctctttctctcaaccatagaaacggtcctgttagccggattgttggctcgcggtaacctgggcgctaaaagcggtccatctcccgcacccagaggggagcagagggaacacggtaaccccggaccacatccggcagaagaaccctcccgaggcgtgaaagggagtcaacgtagctggccggagaccgcagaccggatctttttcctcgtatatgtggtcggcgtgctgtgtacccagttcgttttcgccggtatctggatgtgggctgcctgcaaaagtgatgccgctccaggagaagcagccccacatggccgaagacccaggttgtag

SEQ ID NO: 55982 - DNA, 381 bp, Artificial Sequence
  Description of Artificial Sequence: Synthetic coding sequence
atgatggccttgtggtccctgttgcacctgaccttcttaggcttttctatcactctgctgctcgtccacggccagggttttcagggaacggcagcgatctggcccagtttgttcaacgtcaacctctctaaaaaggtacaggaaagcatccagattcctaataatgggagtgccccattgctggtggacgtgcgggtgttcgtcagcaacgtttttaacgttagctcagtgttacccagggctaccgcactgcattcccatggggactgctccggcagcgcgccttgctcgaaagccaggggcagtggttgccatggactaacacctggcaatcatctaaaagttcagccgccatgcattaatccatcaggggatatctag

SEQ ID NO: 55983 - DNA, 3393 bp, Artificial Sequence
  Description of Artificial Sequence: Synthetic coding sequence
atgtgcaaatgctgcaacctgttcagtccgaatcagtctgagttactctctcacgttagcgaaaaacatatggaagagggcgttaacgttgatgaaattataattccactgaggcctttatcaacacccgaaccgcctaattcctccaagaccggggatgagttcctggtcatgaaaaggaagcgtggcaggccaaaaggaagcaccaagaaaagctctacagaggaagagttggccgagaacattgtcagtccaacggaagattcacctctggcgccagaagaaggcaacagtctgcccccatcatctctggaatgcagcaagtgctgtagaaaattcagcaacacccgacagctgcgcaaacacatatgtattatagtgcttaatctgggggaggaagagggtgaggccggaaatgagtctgacttggaactggagaagaaatgtaaggaggatgaccgcgaaaaagcctctaaaaggccgcgatcccagaaaaccgaaaaagtccagaagatcagcggcaaggaagccaggcagctgagtggcgctaaaaaacctataatctctgtggtcttaaccgctcatgaggctatacctggggctacaaagattgtgcctgtggaggctggcccaccagaaactggcgctacgaactccgagacgaccagcgctgatttagtcccccgtcgcggatatcaggagtacgccatccagcagaccccctacgagcagcctatgaagtctagcaggcttggtcccacccagctaaagattttcacatgcgagtactgtaacaaggtgttcaagtttaagcacagtctgcaagctcatctgaggattcacacgaatgaaaaaccctataaatgccctcagtgttcttatgcttccgcaataaaagccaatctgaatgttcatctgcgcaagcatacaggggagaaatttgcctgcgattattgcagtttcacttgtctgtcaaaaggccaccttaaggtgcacatcgagagagtgcacaagaagatcaaacaacactgccgcttttgtaagaaaaaatacagtgacgtgaaaaatcttatcaagcacattagggacgcacatgaccctcaagataagaaagttaaagaagctctggatgagctttgtctgatgactcgcgaaggtaagcggcagttgctttacgactgccacatttgcgagaggaaattcaaaaacgagctggttgaagaagaattcgccctacagggcgtgaacgccttaaaggaggaagcctgccctggagatacccagctggaagagggccgtaaggagcctgaagcacctggtgaaatgccagcccctgccgtccacctggcctctcctcaggccgagtcaactgccctaccaccctgtgaactcgagaccactgtcgtgagcagctccgacttgcacagccaggaggtggtatctgacgatttcctgctgaaaaatgatacctcatctgcagaggctcacgccgctccggaaaagcctccggatatgcagcatcggtcctcggtccagacacagggcgaggttatcacattgctgctgagcaaggctcagagtgcgggatcagaccaagagagccacggggctcagtcccccctcggcgaaggacagaacatggcggtgctttccgctggcgaccccgatcccagccgctgtctgcggagcaatccagccgaggctagcgacctcctaccccctgtcgctggcggaggggacactatcacccatcaaccagactcctgtaaagctgctcctgaacaccgaagtggcatcaccgctttcatgaaggtgttaaacagcctgcagaaaaaacagatgaacacatcactatgtgagaggattcggaaagtttacggagacctggagtgtgagtattgtgggaaattattttggtaccaggtacattttgatatgcatgtaagaacacacacaagggagcatttgtactattgctcccaatgtcactactcctcaattaccaaaaactgcttaaagagacacgtaatacaaaaacacagcaacattctgttaaaatgcccaactgacggatgtgactattcaactccagacaaatataagttgcaggcacacctgaaggttcacacagcacttgataaacgctcttacagctgcccagtatgcgagaagtcctttagcgaggacagactcataaaatcacacataaagacaaatcacccagaggtatcaatgagtaccatctccgaggtccttggccgtcgggtccagttgaaagggttaattggaaaaagagccatgaaatgtccctactgcgacttctatttcatgaagaacgggtcagatttgcagcgtcacatctgggctcacgagggtgtcaagccattcaaatgctctctgtgtgaatatgctacacggtcaaagagtaacctgaaggctcacatgaacaggcatagtacggagaaaacccatctctgtgacatgtgcggaaagaagttcaagagcaaggggacccttaagtcccataaactgttacatacagccgatggtaaacagttcaaatgcacggtatgcgactacacagccgcacagaagccacagcttcttagacatatggaacaacacgtcagcttcaagccctttaggtgcgctcactgccactacagctgcaatatctcagggagcctcaagcggcactataatcgaaagcaccctaacgaggagtatgctaacgtgggaacaggcgaactcgccgcagaggtgctaatccagcaagggggactgaaatgccccgtgtgcagcttcgtgtacggaacaaaatgggaatttaatagacaccttaagaacaaacacgggctgaaagtcgtggaaattgatggcgatcccaaatgggagactgcaacagaagctcccgaggagccaagcacacagtatttgcatattacagaggccgaagaggatgtgcaggggacacaggccgcagttgccgctcttcaagacctacggtatacaagtgagtccggagacaggctggaccctacagccgtaaacattctccaacagataattgaactcggagccgagactcacgacgccaccgccctggctagtgtggttgcgatggcacctggtactgtgaccgtcgtgaaacaggtcactgaggaggaaccatcatcaaaccatacagtgatgattcaggagaccgtgcaacaggccagcgttgaacttgccgagcagcatcatttggtggtgagctcagacgacgtggagggcatcgagactgtgactgtgtatacccaggggggtgaagcctcagaatttattgtctatgtacaggaagcaatgcagccagtggaggagcaggctgtggagcagcctgctcaggagctctag

SEQ ID NO: 55984 - DNA, 3132 bp, Artificial Sequence
  Description of Artificial Sequence: Synthetic coding sequence
atggctatggcactggaacttcaggctcaggcatcccctcaacccgagccggaggagctcctcatcgtcaaactggaggaagattcttggggatccgaatctaaactttgggaaaaggatcgaggtagcgtttccggtcccgaggctagccggcagcggtttcggcagttccaatacagggatgcagccggaccccatgaggctttttctcagctctgggccctgtgttgtaggtggttgagaccagagatcagactgaaggaacaaatccttgagttgctggtgttggagcagttcctaactatcctgcccagagaagtccagacttgggtccaagccagacacccagaaagtggcgaggaagccgttgctcttgtggaagactggcacagggaaactagaacagcaggccaatctggattggaactgcacactgaggaaacaagaccgcttaaaaccggcgaagaagcccagtcctttcagctgcagcccgtcgatccctggcctgagggtcaatcccagaagaagggtgttaagaatacatgccctgatttgcccaaccacctgaacgccgaagttgctcctcaacccttgaaagagtccgctgtgctgaccccacgcgtgcctacactgcccaagatggggtctgttggggactgggaagtgacagcggagtcacaggaggcccttggacctggtaaacacgcagaaaaagaattatgtaaagacccaccaggagatgattgcggcaattctgtgtgcttgggagtgcccgtcagcaagcccagtaatacttcggagaaagagcaggggcctgagttttggggtctgagccttatcaatagcggcaagagatctactgcagattattccctggacaatgagcccgcacaggctctgacgtggcgcgactccagagcatgggaggagcagtatcagtgggacgtggaagatatgaaggtatcgggcgtgcattgggggtacgaagaaactaagacctttctagccatactatccgaaagtcccttttcagagaaacttcgcacctgccaccagaaccgtcaggtgtaccgcgctatcgccgaacaattgcgagcacgaggatttttgagaactctcgagcagtgcagatatagggtaaaaaacctgctcaggaactatcgaaaagccaaatccagtcaccccccagggacctgcccattttatgaggagctggaagcgttagttcgagcacggaccgccataagagctacagatgggcctggagaagccgtggctcttccaaggttgggttatagtgacgccgagatggatgagcaggaagaaggcggatgggatccagaagaaatggccgaagattgcaacggggctggactcgtgaatgtggaatctacacagggtcctaggatcgctggggcaccagctctctttcagtcacgcatcgcgggagtgcactgggggtacgaagaaacaaaagcgttcctggccattctctctgaaagtcctttttcggaaaagcttcggacatgtcaccaaaactcccaggtctatagggctatagcggagagactgtgcgctctcggatttctgaggacacttgaacaatgccgttatcggtttaaaaatctgctgaggtcatacagaaaggccaagagcagccacccacctggaacatgtcccttttacgaagaactggacagcctgatgagggcacgagctgcagtgcgcgcaatgggaaccgtgcgtgaggccgctggcttgccacgttgtggacagagcagtgccgagaccgatgcacaggaagcttggggagaagtagctaatgaggatgcagtcaagcctagtactctgtgcccgaaggcaccggacatggggtttgaaatgcgccatgaagacgaggaccagatctccgaacaggacatctttgaaggcctgccgggtgctctgagcaaatgccccaccgaggctgtctgtcaacccttggattggggcgaagactcagaaaacgaaaatgaagatgagggccagtggggaaacccatctcaggagcagtggcaggaatccagtagcgaagaagacctggaaaaactgattgaccatcaggggctgtatttggctgaaaagccttacaagtgcgacacctgcatgaagtccttttcgcggtctagccattttattgcacaccaaaggatacacaccggcgagaagccctataagtgcctcgagtgcggcaaaaacttctctgaccgatccaatctaaacacccaccaaagaatccacaccggcgagaagccatataagtgcctggaatgcggcaagagtttttcggatcacagcaatctgatcacacatcagaggattcacacaggtgagaagccctataaatgcggcgagtgctggaaaagtttcaaccagtccagcaatttgctaaaacaccagagaattcaccttgggggtaacccggatcagtgttctgagcctgggggaaacttcgcccaatccccttcgtttagcgcgcactggagaaactcgacagaggagactgccccagaacaaccacaaagcatctccaaagacttgaactcccccggaccccactctactaacagtggggagaagctgtatgagtgtagcgaatgcggcaggagctttagcaagtcttcggcgctgatctcacaccagagaatacacaccggtgagaaaccctatgagtgcgcggagtgcggtaaaagcttttcgaagtcgagtactctggctaatcatcagcggacccatacaggtgagaaaccctacaagtgtgtcgattgcggcaaatgcttctcggagcgctctaagcttatcacccatcagagggtgcacactggggagaagccatataagtgtctagagtgcggaaagttcttccgcgacaggtctaacctcatcacccaccaaaggattcacaccggtgagaagccctacaagtgtagggaatgtgggaagtgcttcaaccagtccagttccttaatcatccaccagagaattcacacgggggaaaagccctacaaatgcaccgagtgtggaaaagatttcaataacagctcccattttagcgctcaccgcagaacccatgcaggaggtaaagcctcctag

SEQ ID NO: 55985 - DNA, 2934 bp, Artificial Sequence
  Description of Artificial Sequence: Synthetic coding sequence
atggccatggcacttgaactccaggcgcaggctagccctcagcccgaaccagaggaactcttgatcgtgaagctagagctacttgtgctggagcagtttctcaccattcttcccagagaggtgcagacttgggtccaggctagacacccagagagtggcgaggaagccgttgccttggttgaggactggcacagagagactcgaacggccggacagtcaggcctggagcttcacaccgaagagacacggcctctgaagactggtgaagaagcccaatcatttcaactccagcccgtcgacccttggcccgagggacagtcccaaaaaaaaggcgtgaagaacacctgtcctgacttgcctaatcaccttaacgccgaggtcgctccccagcctctcaaggaaagcgctgtgctgaccccacgtgtccccacactcccgaaaatgggcagcgtgggtgattgggaggtcaccgcagagtcccaggaggccttgggccctgggaagcacgcggagaaagaactctgtaaagacccgccaggcgatgattgtggaaattctgtttgtctcggagtccccgttagtaaaccttccaacacctctgaaaaggagcaggggcctgagttctggggcctgtccctgattaattctggaaagagatccactgcagactattcacttgataacgaaccggctcaggctttaacatggagagactcacgggcttgggaagaacagtaccagtgggacgtggaggacatgaaggttagcggcgtccactgggggtatgaggagactaaaacatttcttgcgattctttccgagtccccctttagtgaaaagctccggacctgccaccagaacagacaagtgtatagggccatcgcggagcagctgcgcgcaaggggcttcctgaggaccctggaacagtgtcggtatagggtgaagaacctgctgcggaattacagaaaagccaagagctctcacccacccggaacctgccccttctatgaggaactggaggctttggtccgagccaggaccgccataagggcaaccgatggcccaggcgaagctgtcgcgctgcccagactcgggtacagtgacgccgaaatggatgaacaggaagagggaggatgggatcccgaggagatggcagaggactgcaatggggcaggtctggtgaacgtggaatccacacagggtcctaggatcgccggagcacctgcattgtttcagtctaggatcgctggcgtgcactggggctatgaggagactaaggcatttctggccatcctttctgaatcacccttcagcgaaaaactcagaacctgtcaccagaactcccaggtgtatagagccatcgcggagcggctttgcgcgctgggcttcctgcgcactcttgagcagtgtagatacaggttcaaaaatctgctccggtcctatcgaaaagcaaagagcagtcacccaccaggcacatgtcctttctatgaggaattagactcactgatgagagctcgggctgcagtgagagctatgggcacggtgagggaggccgcaggcctccccaggtgtgggcaaagctccgcagaaacagatgcccaggaggcttggggcgaggttgcgaatgaggacgcggtgaagcctagcacattgtgtcctaaggctcctgatatggggttcgagatgcgtcacgaggatgaggatcagatcagcgagcaagacattttcgaaggccttcctggagccctctcaaagtgccccaccgaggccgtctgtcagcctctcgattggggcgaggacagcgaaaatgaaaatgaggacgaggggcaatgggggaatccaagtcaggaacagtggcaggagtcttcttctgaggaggacctggagaagctaatcgatcatcagggactgtacttagccgagaaaccttataaatgcgacacgtgcatgaaaagcttttctcggtcgagtcatttcatcgctcaccaaaggatccataccggcgaaaagccctacaagtgcctggaatgtggaaagaatttcagtgatcgcagcaatctgaacacccatcagcggatacatacaggtgagaagccctacaagtgtctcgaatgtggtaaatctttctctgaccacagtaatctcattactcatcagaggatccatactggcgagaaaccttacaagtgcggcgaatgttggaagtcatttaaccaatccagtaaccttctgaagcatcagcgcatccaccttggagggaaccccgatcagtgctccgaacccggtgggaatttcgcccagtctcccagctttagcgcccattggaggaactctacggaggaaactgccccagagcagcctcaatcaattagcaaggatttgaattcacccggaccccatagcaccaattcaggagagaaattgtacgaatgttccgagtgcggaagatcgtttagtaagtcctcagctctgatcagccatcagcgcattcatacaggggaaaaaccttatgaatgcgccgagtgcggcaaaagtttctctaagagttcaacgctagctaaccaccagcgcacgcacaccggtgaaaagccatataagtgtgtagactgtggcaaatgcttctctgagcgctctaaactcatcacacatcagagagtgcacactggtgagaaaccatacaagtgtttggaatgcgggaaattcttccgcgataggtccaacttgataacacatcaaaggattcacactggcgaaaaaccatataagtgcagagagtgcggcaagtgttttaatcagtcgagctccttgattattcaccagagaatccacacgggcgagaagccgtataagtgcactgaatgtggtaaggactttaataactcatcacacttttccgcgcacagaagaacgcatgccggaggtaaagcatcttag

SEQ ID NO: 55986 - DNA, 1284 bp, Artificial Sequence
  Description of Artificial Sequence: Synthetic coding sequence
atggcaatggcactcgaactgcaagcacaagcatcaccgcagccggaacctgaggagttgctgatagtaaagcttgaggaggatagctggggtagcgagagtaaactttgggagaaagaccggggatctgtctccgggccagaagccagtaggcagcgctttaggcagttccagtatcgggacgccgctggcccacatgaggcgttctctcagctgtgggccctgtgttgtagatggctgcgaccagaaattcgcctcaaagagcaaattctcgagttgctggtgttagaacaattcctgacgattctaccccgagaggtgcaaacttgggtccaggcaaggcaccctgaatccggtgaagaggccgttgcactggtcgaagattggcatcgggaaacccggactgcaggccagagcgggctggaactccacaccgaggagaccagacccctgaagacaggtgaggaggcccagagcttccagctgcaacctgtcgacccttggccagagggccagagccaaaaaaaaggagtcaaaaatacctgtcccgacctcccaaatcacctgaacgctgaagtcgcgccacaaccactaaaggaaagcggcgtgcccgtgtcaaaaccaagcaacacatctgaaaaggagcagggcccagagttttggggcctgtcgttgatcaatagcggtaagcgttccaccgctgactactctctggacaacgagccagcacaggcactgacttggcgcgatagtcgggcatgggaggaacagtaccagtgggatgtcgaggacatgaaagtcagtggggtccattggggatacgaggagacaaaaacattcctcgcaattctctccgagtcaccgtttagtgagaaactcaggacgtgccaccaaaatagacaggtttaccgtgctatcgcagagcagctgcgcgcaagggggtttcttcgaacactggaacagtgtcgctatcgagtgaagaacctgctgcgtaactataggaaggctaaaagctctcatcctcccggtacttgtccattttacgaagagctggaggccctggtaagggctcgcaccgcaatccgagccactgatggcccaggggaggcagtggccctgccaagactgggttactctgatgccgaaatggatgaacaggaggagggcggatgggatccagaggagatggcagaagactgtaatggagccggattggtgaatgtggaatctacgcaggggccacgcattgccggtgcgcctgcgctctttcagtcaagaatctag

SEQ ID NO: 55987 - DNA, 1302 bp, Artificial Sequence
  Description of Artificial Sequence: Synthetic coding sequence
atggccatggcactggaactgcaagcacaggcctcaccccagccagagcctgaggaattactgatcgtgaagctggaagaagacagctgggggtcagaatcgaagctgtgggagaaggacagaggtagtgtgtccggccctgaggcatcaagacagcgcttccggcagttccaataccgagatgcagcaggcccacacgaagcattttcccagctgtgggctctgtgttgtaggtggcttagacctgaaattagactcaaggaacagattctggaactgttggttctagagcaatttcttaccatcttgcctcgcgaggttcagacctgggtgcaagccagacatcccgaatctggcgaagaggctgtggcgcttgttgaggattggcatagagagacgaggacagccggtcagagcggccttgagctgcatacagaagaaacacgccctcttaagaccggtgaagaggcccagagtttccaactacaacctgttgatccatggcctgaagggcagtcccagaagaagggcgtcaagaatacctgtccagacctacctaatcacctgaacgcggaggtggccccacagccccttaaggaaagcggcgttccggttagcaagccctcaaacacatccgagaaagagcaaggcccagagttctgggggctgagtcttatcaactcaggcaagcgcagcaccgctgattactcgcttgacaacgagccggcacaggctctaacctggagagactctcgcgcttgggaagagcagtaccagtgggacgtagaagacatgaaggtcagcggcgtgcactgggggtacgaggagaccaagacctttctcgcaattctatccgaaagccctttttccgagaagctaagaacctgtcaccagaaccgacaggtctacagagctattgcagagcagctgcgcgcacggggttttctgagaaccctcgagcagtgtagatatagagtcaaaaacctgctccgcaattataggaaagcaaagtcctctcaccccccagggacctgtccattctatgaggaactggaagccttggtccgagccaggacagcaatcagggctacagatgggcctggggaggccgtggcgctgcccaggctggggtatagtgacgcggaaatggacgaacaagaagaaggagggtgggacccagaggagatggccgaggattgcaatggagcaggactggtcaatgtggaaagcacgcagggacccaggatagccggagcccctgcccttttccagtctcgtattggtaagaatatgggcgtgtag

SEQ ID NO: 55988 - DNA, 2934 bp, Artificial Sequence
  Description of Artificial Sequence: Synthetic coding sequence
atggccatggctttggagcttcaggcccaggcttccccccagcccgagccggaggagctgctgatcgtgaaattggagcttttggttctcgagcagttcctgactattcttcctagagaggttcagacatgggtccaagcacgacaccctgaatctggggaagaggccgtggccctggttgaggactggcatcgggaaacccgcacagcagggcagtcgggactggagctgcataccgaggaaacacgcccacttaagactggggaagaggcacaatctttccagttgcagccagttgacccatggcctgaaggacagtcacagaaaaaaggcgtgaagaacacgtgcccagacctccccaaccacctgaacgccgaagtggcccctcagcctcttaaggagtctgcggtgctgacgcccagggtgcctactctgcctaaaatgggctctgtgggggattgggaggtgacggccgagtctcaggaggcactcggccctggaaaacatgcggagaaagagttatgcaaggatcctccgggagacgactgcggcaattcagtgtgcctcggcgtgccagtgagtaagccatctaatacctccgaaaaggaacaaggcccagagttttggggtttatcactcatcaattccggtaaaagaagcacagctgactacagtctcgataatgaacccgctcaagctcttacctggcgggatagccgtgcttgggaggagcagtaccaatgggacgtggaagatatgaaggtgtcaggcgttcactggggatacgaggaaacaaaaactttcttagccatactgagcgaatcacccttctctgagaagctgcggacatgtcaccagaatcgccaggtataccgtgccatcgctgagcagcttcgggcacgagggttcctccgcacgctcgagcagtgtcggtacagagtgaaaaacctcctgaggaattatagaaaggctaagagctctcacccgccaggaacatgtcccttctacgaggagcttgaagctttggtcagagctcgaactgccatccgggctaccgatggacccggagaggcagtggctctgccgagactgggctatagcgacgccgaaatggatgaacaagaagagggcggttgggatcctgaggagatggcggaagattgcaacggggctggccttgtgaacgtcgagtccacccagggaccgcgtatcgccggagccccagccctgttccaaagcaggatcgctggcgtccattgggggtacgaagagactaaggccttcctcgctatcctgtccgaatctccatttagcgagaaactcaggacttgtcaccaaaactctcaagtttaccgagccattgcggaacgactgtgcgccctcggattcctgagaacactcgaacaatgcagatatcgattcaagaatcttttgcgttcataccgtaaggctaagtcttcacaccctccaggaacttgtccgttctatgaggagctggacagtctgatgagggctagggctgcagtccgcgctatgggcaccgtccgggaagcagccggacttccacggtgcggccagtcatccgccgaaacagatgctcaggaggcctggggagaggtcgctaatgaggatgctgtaaaaccttccactctatgcccgaaggctccagatatgggattcgaaatgaggcatgaggacgaagaccagataagcgaacaggacatcttcgaaggccttcctggggcactgtcgaagtgtcctacagaggccgtgtgccaacctctcgactggggggaggatagcgaaaatgaaaatgaggatgaagggcaatggggcaacccctctcaggagcagtggcaggaatcttcgagcgaggaggatcttgaaaagttgatcgaccaccaaggattgtacttggcggaaaagccctacaaatgtgacacgtgtatgaaatcattttcccggtccagtcacttcatcgctcaccagaggatacacaccggtgaaaagccctataagtgcctggagtgcggcaagaacttctctgaccgctccaacttgaatacccaccaacgtatacatactggtgaaaagccttacaaatgtctggagtgcgggaaatcattctccgatcactcaaatcttataacccatcagaggatccacaccggcgaaaaaccgtacaagtgcggagaatgctggaaatcttttaaccagagctccaatcttctcaagcatcaacggatccacctggggggaaatcccgaccagtgcagtgaacctgggggtaactttgcccagagccctagttttagcgcccactggcggaactcaaccgaagagaccgcccctgaacagccacagtccatcagcaaagacttaaactcacctggacctcattccacgaattctggcgagaagctctacgaatgtagcgaatgtggtagatctttcagcaagtcgtcagccctgatatctcatcagaggatccacaccggggagaagccttatgaatgtgccgaatgtggcaaatcctttagcaagtcaagcacactggcgaatcaccaacgcacccacaccggtgagaaaccctataaatgtgtagactgtggcaagtgctttagcgaaagatctaaattgataactcatcagcgagtccatacgggcgagaagccctataaatgtctggaatgcggcaagttttttagggaccggagtaaccttattacacaccaaagaatccacaccggtgaaaagccttataagtgcagagagtgcggcaagtgtttcaatcagagttcctccctgatcattcatcagcggatccataccggagagaaaccctataagtgcactgagtgtggcaaggactttaataatagcagccatttttccgctcaccggcgaacccatgcaggaggaaaggccagttag

SEQ ID NO: 55989 - DNA, 1800 bp, Artificial Sequence
  Description of Artificial Sequence: Synthetic coding sequence
atgagtggtccatgtggcgagaaaccagtcctggaagcttctccaaccatgtccctgtgggagttcgaagactcacattcacgtcagggtacacctaggcccggacaggagctggccgctgaggaagcttccgctttggagctacagatgaaagtcgacttcttccgaaagctgggatatagctcaaccgaaattcattccgtcttacagaaattaggtgtgcaggctgacaccaacaccgtgctaggggagctggtgaagcacgggacagcaactgagagagagaggcagactagccctgacccgtgccctcaactcccacttgtgccaagaggagggggaaccccaaaagccccaaatctcgaaccgccattaccagaagaagaaaaggaaggctctgacctccgcccagtggtgatagatggatcaaacgtagccatgtctcatggaaataaagaagttttttcttgcagagggattctgctagctgttaactggtttctcgaacgtggtcacacagatatcacggttttcgtcccgtcttggaggaaagaacagcctagacctgatgtgcccatcacagaccaacatattctgcgtgaactcgagaaaaaaaagatactggtattcacaccgtcgcggcgtgttgggggtaagcgcgtggtttgctatgatgatcgcttcatcgtgaagcttgcttatgaatctgacgggatcgtcgtctcaaatgacacttatcgagatctgcagggtgagcgccaagaatggaagcgatttatagaagaaaggctcctaatgtactccttcgtcaatgataaattcatgccaccagacgaccccctaggtcgacacggccctagtctggacaactttctccggaaaaagcccctcacattagagcaccggaagcagccctgtccatacggaagaaaatgcacttacggcatcaaatgtcgtttcttccaccccgaaagaccgagttgcccccagagaagcgtggctgacgaactgcgagccaacgctctcctctctccacccagagccccatctaaggacaaaaatggacgcagaccttccccttcctcccagtcctccagcctactgaccgagagcgagcagtgcagtctcgacggaaaaaaactgggggcacaggcatctcctggctccagacaagagggtctcacccagacatacgctccatcaggaaggtcactcgcaccttcaggcggttctggctcttcttttggacctacggattggctaccccagactctcgattccctgccctatgtttcacaggactgccttgacagtgggattggctcccttgaatctcagatgtccgagctgtggggggtgcggggtggagggcctggagagcctggcccacccagggcaccatataccggctacagcccttacggatccgaattaccggctacagcagcctttagcgcgtttgggagagcgatgggcgcaggacacttttccgttcctgccgattacccccctgccccaccggctttccccccacgggagtattggtcagaaccttatccacttccccctcccaccagcgttctgcaggaaccaccagtacagagccctggcgcagggcgttccccctgggggagggctgggtcactcgctaaggagcaggcatcagtctatacgaagctatgcggggtgtttcctccccatttagtcgaggccgtgatgggacgctttccccaattgctggatccccagcaactagccgcagagatacttagttataagtcccagcatccgtcagaatag

SEQ ID NO: 55990 - DNA, 1800 bp, Artificial Sequence
  Description of Artificial Sequence: Synthetic coding sequence
atgtcaggaccttgtggagagaagccagtgctagaagctagtcccacgatgagtctctgggagtttgaggactctcactcacgccaaggcacccctagaccgggacaggaattggcagccgaggaggccagtgcgttagagctgcagatgaaagtggacttcttccgcaagctcggatactcttctactgaaatccactcagtgctgcagaaattgggagtccaggctgacaccaacacagtgctcggtgagcttgtgaagcatgggacggcaaccgaacgagagcggcaaacatcacccgacccatgtccgcaattgccacttgtcccacgaggcggtggaactccgaaggcgcctaatctggagccccctttgcccgaagaggagaaggaagggtctgatcttcgaccggtggtaattgacggaagcaatgttgccatgtcgcatggtaacaaggaagtattttcttgtagaggaatcttgctagcagtgaactggttcctcgaaaggggacatactgatattacagtgttcgtccctagctggcgcaaagagcagcccaggcctgatgtgccaattactgaccagcacatcctgagggagctagaaaagaagaaaattctggtattcaccccctccaggcgggtgggaggcaaacgggtagtgtgttacgacgaccggttcattgtgaagctggcttatgaaagcgatgggatcgttgtttccaacgacacttatagagacttgcagggtgaaagacaggagtggaagcggtttattgaagaacgtctcctcatgtacagcttcgtcaatgataaatttatgcccccagatgaccctctgggtagacatggaccaagcctggacaacttccttcgaaagaaacctctgacattggagcatcggaagcagccttgtccctacggacggaagtgtacatacggtatcaagtgccgcttttttcaccccgagcggccatcctgtccacagagatcagtcgctgatgaactacgggcaaatgcactcttgtctccacccagggccccttccaaggacaaaaacggcagaagaccgagtcccagcagccagtcctcttccctgctgactgaatccgagcaatgctccctggatggcaaaaagttgggcgctcaagcctctcccggtagccggcaggaaggactgacacagacatatgctccatccgggcgttctctcgcgccttcaggcggaagtggtagctcgtttgggccaacagattggttgccccaaacccttgactcactcccctacgtgagccaggactgcctggacagcggcattggcagtctggaaagtcagatgtctgagctctggggtgtcagaggtggcggacccggtgaacctggcccacccagggctccatacaccggttactccccgtacggcagcgagttgccagccaccgccgctttttcagccttcggcagggccatgggcgcaggacacttcagcgtgccagctgattatccccctgctcctccagcctttcccccacgggagtactggtctgagccttatcccctccctccaccaaccagcgtcctgcaggagccgccagttcagtccccaggcgcagggaggagcccttggggtagagcaggttctctcgctaaggagcaggccagcgtctacaccaaactgtgcggcgtttttccaccacaccttgttgaagccgtgatgggcagatttcctcagcttcttgacccccagcaactggcagcagagatcctgtcctacaagtcccagcatccctctgagtag

SEQ ID NO: 55991 - DNA, 1281 bp, Artificial Sequence
  Description of Artificial Sequence: Synthetic coding sequence
atgccacccaaaaaacaggctcaggcgggtggcagtaaaaaagctgagcagaagaaaaaagagaagattatcgaggataagacttttggcctgaaaaataaaaaaggtgcgaaacagcaaaagttcatcaaggcggtgactcaccaagtgaagtttggccagcagaatccaagacaggtagcccaatccgaagccgaaaagaagctgaaaaaagacgataaaaaaaaggaactgcaggagctgaacgagctctttaagcctgtagtggccgcacagaagattagtaagggtgcagacccaaagtcagtagtgtgtgctttcttcaaacagggacagtgcactaaaggtgataagtgcaagttctctcacgacctgaccctggaaagaaagtgtgagaaaaggtctgtatacattgatgccagagatgaggagctggagaaggataccatggacaactgggatgaaaagaagctcgaggaagtggtgaataaaaagcacggcgaggccgagaagaaaaagcccaagacccagatcgtgtgtaaacatttcttggaggccatcgaaaacaataagtacggatggttttgggtgtgccccggaggaggcgacatctgcatgtaccgccacgccctgccccctggattcgtcctgaagaaggacaaaaagaaagaggaaaaggaggatgagattagtctcgaagacttaatcgagcgggaacggtctgccttagggccaaacgtcactaaaatcactctggagtcgttcctagcatggaaaaaacgtaagcgacaagaaaaaatcgataagctggaacaggatatggagagacgcaaggccgactttaaagctggcaaggcactggtgatcagcggcagagaggttttcgaatttcggccagagctcgtcaacgacgacgacgaagaggctgatgatacgcggtatacccagggaaccggcggtgatgaggtggatgactccgtctcagtaaatgacattgacctgtccttgtatatccccagggacgtggatgagacgggcatcaccgtagcgtccctagagcggtttagcacttacacctccgataaagatgaaaacaagctgtccgaagcgagcggcggacgagccgagaacggcgagagatctgacttggaagaggacaatgagcgagaggggactgaaaatggtgccattgacgcagtccccgtggacgaaaatctattcacgggagaggatctagacgaactagaagaggaactcaacactcttgacctcgaagagtag

SEQ ID NO: 55992 - DNA, 1179 bp, Artificial Sequence
  Description of Artificial Sequence: Synthetic coding sequence
atgccaccgaagaaacaagctcaggcaggcggttcaaagaaagctgaacagaagaaaaaagaaaaaataatcgaggataaaacttttggcttaaaaaacaagaagggcgctaagcaacagaagttcattaaggccgtgactcatcaggtcaaatttgggcagcagaacccacgtcaggtggctcagtctgaagccgaaaagaagctaaaaaaggatgacaagaagaaagagctacaggagctcaatgagctttttaagcccgtcgtcgcagcgcagaagattagcaaaggcgcagacccgaaatcggttgtatgtgccttctttaagcagggccaatgtactaaaggcgacaagtgcaagttctcgcacgacctaacactggagagaaaatgcgagaagcggagtgtttacattgacgctcgggacgaagagctggagaaggatactatggataactgggatgaaaagaaactagaggaggtcgtgaataagaagcatggtgaagcagaaaaaaagaagcccaagactcaaatcgtgtgcaaacactttctagaggcgatcgagaacaacaagtatgggtggttttgggtgtgtcctggtgggggagacatatgcatgtataggcatgctttgcccccaggctttgtgctgaagaaggacaagaaaaaagaagaaaaggaggacgagattagcttagaggatttaatcgaaagggaacgctcggcacttgggccaaacgtcaccaagatcactctcgagtcattcctggcgtggaaaaagaggaagcgccaggagaaaatcgataaacttgaacaagatatggaaagacggaaggccgactttaaagcgggtaaggctcttgtcatctccggacgggaggtgttcgaattccgaccagagctggtcaacgatgatgacgaggaggccgatgacacacgttacacgcagggcaccgggggagacgaagtcgacgatagcgtgtcagtcaatgatattgatctgagtctgtacatacccagagacgtcgacgagacgggcatcacagtggccagcttagagagattcagcacctacacaagcgacaaggacgagaacaaactttccgaagcctccggcggaagagctgaaaacggagagcgctctgacctggaggaggacaacgaaaggcatgtcctgtag

SEQ ID NO: 55993 - DNA, 489 bp, Artificial Sequence
  Description of Artificial Sequence: Synthetic coding sequence
atgtataggcacgccctgcccccaggttttgtgctaaaaaaggacaagaagaaggaggagaaagaagacgaaatctcactcgaggatcttattgaaagggagagatccgccttgggaccgaacgtaaccaaaattaccctggaatccttcctggcttggaaaaagcgcaaaagacaggaaaaaattgacaaactagaacaggacatggaacgcaggaaggcagactttaaggcagggaaagccctagtgatctccgggagggaggtgttcgagtttagacctgagttagttaatgatgacgatgaagaggccgacgatacacgttatactcaggggaccggaggcgacgaggtccggggatctttcgtgcctcaccttttaatgctcatcgaacggaataaccggaagtaccataatatggttaagagtcaccaacaccaatcgcatagtgcatgggtccagattctgacccccaccatgggtaattag

SEQ ID NO: 55994 - DNA, 1269 bp, Artificial Sequence
  Description of Artificial Sequence: Synthetic coding sequence
atgtttcaaacggcatggcgccaggagcctgtcacctttgaggatgtcgccgtttacttcacccaaaacgagtgggcaagcctggatagtgttcagagagccctataccgagaagtcatgttggagaactacgctaatgtggcttctctggcattcccgtttactacccccgttctcgtcagtcagttggaacaaggcgagctgccatgggggctcgacccatgggagccaatgggacgagaggccctgagaggcatctgcccgggagacgaagctcgaacagaaaaagaaggccttaccccaaaagatcacgtgtcgaaggaaactgaatcattcaggcttatggttggcggactcccgggtaacgtgtcccagcatctagacttcggcagtagtctcgaacagcctcaggggcattggataataaagaccaaaagcaaacgaagacacttcaccgatacgagtgctcgccaccatgaggcttacgaagttaagaatggagaaaaattcgagaaattaggcaagaacattagcgtcagcacgcagcttaccacaaatcaaactaacccctccggccagatctcgtacgaatgtggtcagtgtggcaggtacttcatccaaatggctgatttccataggcacgaaaaatgccacactggggagaagagtttcgaatgtaaggagtgcggcaaatactttagatacaatagcttacttattcgccatcagattattcacacagggaaaaaacccttcaagtgtaaagagtgtggaaagggcctgagcagcgataccgctctgatccagcaccagcgcattcatacgggtgagaagccatacgagtgcaaggagtgtggaaaggcttttagtagctcttccgtgtttctgcagcaccaaagattccacaccggcgaaaaactgtatgagtgcaacgaatgttggaagacattcagttgttcttcatccttcaccgtgcatcagcgcatgcacacaggtgagaagccatacgagtgcaaggaatgcggcaagcgattgagctcgaacaccgctttgacgcagcatcagcgaatacacacaggcgaaaaaccattcgagtgtaaagagtgcggaaaggcattcaatcagaagatcacacttatccagcaccagcgcgtgcacactggcgagaagccttacgaatgcaaagtttgcggtaagacgttctcctggtgtgggagattcatccttcatcagaaactacatacccagaagacacctgtgcaggcatag

SEQ ID NO: 55995 - DNA, 354 bp, Artificial Sequence
  Description of Artificial Sequence: Synthetic coding sequence
atgtttcagacggcatggagacaagaacccgtgacattcgaagacgtcgccgtatactttacacagaacgaatgggcctccctcgactctgtgcagagagccctctacagagaagtgatgctcgagaactacgcaaacgtcgcgagcctggcctttccatttaccacccccgtgcttgtgtctcaactggagcagggtgaactgccatgggggctagatccttgggagccaatggggcgagaagccttacgaggcatttgcccaggcgatgaggcgagaaccgaaaaggaagggctcaccccaaaagatcatgtgtcaaaggaaacggagtcttttcggctgatggtgggttag

SEQ ID NO: 55996 - DNA, 933 bp, Artificial Sequence
  Description of Artificial Sequence: Synthetic coding sequence
atgggcctctgcaaatgccctaagagaaaagtaaccaatcttttctgtttcgaacaccgcgtgaatgtgtgcgagcactgcctggtggcaaaccacgccaagtgcatcgtgcagagctatctgcagtggctgcaggactcagactataaccccaattgccgactttgcaacattccattagcttccagggagaccactcgacttgtttgttatgacctgttccattgggcctgcttgaacgagcgcgctgcacagctccccagaaacactgcccctgccggttaccagtgtccctcatgcaacggaccaatattcccgccaaccaacctggcgggaccagtggcctctgccctccgggaaaagctagccaccgtaaattgggcgagggccggtctagggctccctctgatcgatgaggtggtaagccccgagcccgagcccttaaatacctcagatttcagcgattggagtagtttcaacgcctctagcacacctgggcctgaagaggtggattccgcatcagctgccccagcgttttacagccaggcgccaaggccgcctgctagccccggaagaccagagcagcacactgtcattcacatgggaaatcccgagcccctgacccacgcgcctaggaaggtttatgatacgcgagacgacgatagaacccccggtcttcacggggattgcgatgacgacaagtatagacggcgtccagccctgggatggctggccaggctgttgagatcgagagccggtagtaggaaacgccctctgactttactccagcgggctggactcctgttactgctcggcctgctcggcttcctggccctgttggcactaatgtccaggctgggcagagctgctgcggattctgatccaaacttagacccgttgatgaacccacacattagggtcggcccttcctag

SEQ ID NO: 55997 - DNA, 567 bp, Artificial Sequence
  Description of Artificial Sequence: Synthetic coding sequence
atgggcctgtgcaagtgtccaaaaagaaaagttactaatctgttctgctttgagcaccgagtgaacgtgtgtgaacactgcctcgtggccaaccacgctaagtgcattgtgcagtcttatctgcagtggctccaggattcggactacaaccctaactgcaggctctgtaacatccccttggcatcacgggagactaccaggctcgtctgctatgatctttttcactgggcatgcctgaacgaacgcgctgcgcagcttcccagaaatactgcgcctgcagggtatcaatgcccctcatgcaacggtccaatattcccacccactaacctcgcgggtcccgtggcatctgccctccgtgaaaaactggctaccgttaattgggcgcgagccggtctggggctaccacttatcgacgaagttgttagccccgaacctgagccgctcaatacgtccgacttctcagattggagcagctttaacgcatcctctaccccaggaccagaagaagtggactctgcctcggcggcaccggctttttacagccaagcaccgaggccccctgcatag

SEQ ID NO: 55998 - DNA, 624 bp, Artificial Sequence
  Description of Artificial Sequence: Synthetic coding sequence
atgggattgtgtaagtgtcctaaaagaaaggtcactaacctgttctgctttgagcatcgtgtcaatgtttgtgagcactgtctcgtggcaaatcacgccaaatgtattgtgcagtcctacctgcaatggctccaggattcagactacaaccccaactgcagactttgtaacatacctctcgccagcagggagacaacccgactggtgtgctacgacctctttcactgggcatgcctgaatgagagagctgcacagctgccccgaaataccgccccagcgggttatcagtgtccgagttgtaacgggccaatatttccccctaccaatttagccggtcccgtggccagtgcccttcgggaaaagctcgctacagtcaattgggctagagctggcttagggctgccactgatagacgaggtggtatctccagagcctgaaccactgaacacttctgatttctcagactggagttctttcaacgcatctagtacgcccggacctgaggaggtggattctgcatcagcagcaccagccttctattcccaggcccctcgcccacctgcttccccaggccgtcctgaacagcacacagtaatccatatgggcaatcccgagcccttgtag

SEQ ID NO: 55999 - DNA, 1458 bp, Artificial Sequence
  Description of Artificial Sequence: Synthetic coding sequence
atgtacaaaatgaatatctgcaataagccgagcaacaagacagcccctgagaagagcgtgtggacagcccctgcacagccctccggcccttcacccgaacttcagggtcagaggtcaagacgcaatggctggagctggccaccgcatccactgcagatcgtagcctggttgttatatctcttcttcgccgtgatcggcttcggaattctcgtgcccttgttgcctcaccattgggtgccagccggatacgcctgtatgggggctattttcgcaggacatctggtcgtgcacctgactgcagtgtctattgaccccgctgacgcgaatgtgcgggacaaaagttatgccggtccactgcccatcttcaaccgctcccagcacgcccacgtaatagaagatttacactgcaacctctgtaatgtcgatgtcagcgctaggtcaaaacattgctctgcctgtaacaagtgcgtctgcggattcgatcatcattgtaaatggctgaacaattgtgtaggtgaaaggaactaccgcttgtttctacatagtgttgcttctgccctgttaggtgtcctgcttttagtgctggtggctacatacgtctttgtcgaattctttgtgaacccaatgcgcctgcgcactaacaggcatttcgaggtactaaagaatcataccgacgtgtggtttgtcttcctccctgctgcgcctgtagaaactcaagcacccgcaatccttgcattggctgctctgctgattttgctgggccttctcagtaccgcgctcttggggcacttgctgtgctttcacatatacctgatgtggcataagctcacgacttacgaatatatcgttcagcacagaccaccccaggaagccaaaggagtccacagagaattagagagttgcccacctaagatgagacctatacaggagatggagttttacatgcgaacttttcggcacatgcgccctgagcctcctggccaagctggcccagctgctgttaatgctaagcatagcaggccagccagtcctgatcctacgccagggcgaagggattgcgctgggccacctgtacaggttgaatgggaccgcaaaaaaccgctcccatggcgcagccctcttttgttgttagccatgtgggggccacaagcaccaccatgcctctgtcgaaaaagggggagaggggcttgtatcaagtgcgagcggctccggcctcgcatcaggcggagaggactgggacctcctgcagccgcaccggctagaagacggatacccagaaccccagctctctgtaccccgctcgccttgcctgctccaactactagacgacgacagtctccgtggactagatttcagtggaggcgcagggcttgggccgctccactatggccccctagaggggcaggagctgactcgcctaggtggaggggcagacgcgtccgtccacctttcagttag

SEQ ID NO: 56000 - DNA, 1239 bp, Artificial Sequence
  Description of Artificial Sequence: Synthetic coding sequence
atggacacccggagcggctcacaatgctcggtcacgcctgaggctatcttaaacaacgagaagctcgtgttgcctccacgcatctctcgggtcaacgggtggtccctcccgctccattactttcaggtcgtcacctgggctgtctttgtggggttaagctcagccacttttgggatttttattcccttccttccacacgcctggaagtatattgcttatgttgttacaggtggcatatttagtttccacctggttgtgcatttaatcgcctcttgtatcgacccagcagactcaaacgtcagacttatgaaaaattacagccagcccatgcctctgtttgaccggtccaagcacgcacatgtaatacagaatcagttctgtcatctctgtaaagttaccgtgaacaagaagaccaagcattgtatttcctgtaataagtgtgttagtgggtttgatcatcattgtaagtggataaataactgcgtaggctcaagaaattactggtttttcttctcgaccgttgcctctgcaactgctggaatgctgtgtcttatcgccatcttactgtacgtcctcgtacagtacctggtaaatccgggagtgctgagaacggacccacgttatgaagatgtcaaaaatatgaacacctggctgttgttcctgccgctgtttcccgtccaggttcaaacccttatcgtcgtgattataggtatgctggtcctcttgctcgattttctgggcctagtgcacctcggccagctgctgatattccacatctacctgaaagccaaaaagatgaccacatttgaataccttatcaacaaccgcaaggaggagtcctcaaagcaccaagcagttcggaaggatccatacgtacagatggataagggggtgctgcagcaaggcgcaggcgcacttgggagttccgcccagggcgtaaaggccaaatcatctctgctgatccataagcacttgtgtcacttctgcactagtgttaaccaagacggtgattccaccgctagagaaggcgatgaggatccttgcccttctgcacttggggcaaaggcccgtaattcccggctgatttgccgcagactttgccagttttcaactagggtgcatcctgatggcggaagcatggcccaagaggctgatgatgctcctagtatctccactctcggcctgcagcaagagactacagagcccatgaagacagattccgccgaatctgaggactag

SEQ ID NO: 56001 - DNA, 1239 bp, Artificial Sequence
  Description of Artificial Sequence: Synthetic coding sequence
atggatacgcggagcggctcacagtgcagtgttacccccgaagctattctaaataatgagaaattggttctcccaccaaggattagccgagtcaacgggtggagtcttcctcttcactattttcaggtggtgacatgggctgtttttgtgggcctcagcagtgccacattcggcatctttattccctttctcccacatgcctggaaatacattgcatatgtggtcacgggaggaatcttctcttttcacctcgtggttcacctaatcgcgtcgtgcatcgatcccgcagacagtaacgtgcgactgatgaagaattacagccagccaatgcctctgtttgatcggtcaaagcacgctcatgtgattcaaaaccagttctgtcacctgtgtaaagttactgtgaataagaaaacaaagcactgcatcagttgtaacaaatgcgtttctggtttcgaccaccattgcaagtggataaacaactgtgtggggtcaaggaactactggttcttcttttctaccgtggcatcagctactgccggaatgttatgcctgatagccatcctactgtatgtcttggtgcaataccttgtaaaccccggagttctgcggactgatccaaggtatgaggatgtcaaaaacatgaatacatggcttctattcctcccgttgttccctgtgcaggttcagacactgatcgtcgtgataatcgggatgctggttctcctgctggatttcttgggcctggttcatctcggacagctcttgatctttcacatttatctcaaggccaaaaaaatgaccaccttcgagtatttaattaacaatagaaaagaggagtctagcaagcaccaagctgtgcggaaagatccttatgtgcaaatggacaagggggtgctgcagcagggagccggtgcactgggtagctcggcacagggtgtgaaggccaagtcatcccttctaatccataaacatttgtgtcacttctgtacgagtgtgaatcaagatggagattcaaccgctcgagaaggtgacgaagatccttgccccagtgccctcggagctaaagcccgaaacagcagactgatttgccggagattatgccagttctctactcgggtgcacccagatggcggatccatggcacaggaggctgacgacgcaccaagcatctcaactctgggcctgcagcaagagacaacagaacctatgaagactgatagcgccgaatccgaggactag

SEQ ID NO: 56002 - DNA, 804 bp, Artificial Sequence
  Description of Artificial Sequence: Synthetic coding sequence
atggctccgtgggccctactgagtcctggagtgctggtcagaacagggcacacagtgctgacgtgggggattaccttggtgctgttcctgcacgacacagaactgcggcagtgggaggagcaaggcgagttgctgcttccgctgactttcttgttgctggtactgggctctctgttgttgtatctcgccgtgagtctgatggacccaggctacgtgaacgttcagccccagcctcaggaggagttaaaggaagagcagacggctatggtgccccctgctatccccctccgacgatgccgctactgtctcgtcctgcagcccctgcgggcacggcactgccgggaatgtcgacgctgtgttcgtcgttacgaccaccattgtccctggatggagaactgtgtgggcgagagaaaccatcctttatttgtcgtgtacttggcactgcagcttgtagtgctcctgtgggggttatatctggcctggtctgggctccggttctttcaaccctggggtcaatggttaagaagtagcggtttgctattcgctacgtttctattactgtcattgttcagcctagtagccagtctgctgttggtcagccacctatacctggtggcttctaacactaccacctgggaattcatttcctcgcacaggatcgcctatttaagacagaggccaagtaaccctttcgaccggggtctgacccgaaacctcgctcatttcttctgcgggtggccctcaggttcttgggaaacgctatgggcagaggaggaggaagaaggaagctcaccagcagtgtag

SEQ ID NO: 56003 - DNA, 648 bp, Artificial Sequence
  Description of Artificial Sequence: Synthetic coding sequence
atggcaccctgggcgctgctgtcacctggtgtgctcgtgcggacagggcacaccgtattgacctggggaattactctggtacttttcctccacgacacagagctgcgccaatgggaggaacagggggagctgctccttcccctcaccttcctgttattggttcttggaagcctgctgctctacttggctgtttcattgatggatcctggctacgtgaacgttcaaccacagccgcaagaggagcttaaagaggagcaaactgcaatggtcccaccagccatccctctgcggaggtgcagatactgtctcgtgctccagcccctcagagcacgacattgcagggaatgcagaagatgcgtgcggcgttacgaccaccactgcccttggatggaaaattgcgtcggtgagcgcaaccatcctctctttgtggtgtatctggcactgcaactcgtggtgctgctttggggtctttatttggcctggagtggcctgcgtttctttcagccatggggccagtggctccgatcaagtgggttactatttgccaccttcctcctcctctcacacttcttctgtggctggcctagtggatcatgggagaccctgtgggcagaggaggaagaagaaggctcaagccccgctgtctag

SEQ ID NO: 56004 - DNA, 846 bp, Artificial Sequence
  Description of Artificial Sequence: Synthetic coding sequence
atggccccatgggctttactttcaccgggagtgttggtccggaccggacatactgtgctgacctgggggataacactggtccttttcctgcacgatactggtgaaccagatcccgagaggccgaggacacaccctatcccccagctacgacagtgggaggaacaaggagaattactactacctctgacttttctgttattagtcctggggagtctccttctgtatcttgcagtaagcctgatggacccgggatacgtgaacgtccagccacagccacaggaggagctgaaggaggaacagactgctatggtcccgcctgcaatccccttgcgacgatgtagatattgccttgtgttgcagccactaagagcgaggcactgcagagagtgccgcagatgcgtccgcaggtacgaccatcactgtccttggatggaaaactgtgtcggagaacgcaaccaccccctattcgtagtctacctggcactgcagcttgtcgtactcctgtggggactatatcttgcatggagtggcctcaggttcttccaaccttggggacagtggctccgtagcagtgggctgttgttcgctacatttctgttgctgtcactcttctccttggtggcctcccttttactcgtgtcacatctctacttggtggccagcaatactacgacatgggagttcatctcgagccacaggattgcctacctccgacaaagacccagcaatcccttcgatcggggactgacccggaatttagcccactttttttgtggctggccttcagggtcgtgggaaacgctttgggcagaagaggaagaagaaggaagctccccagctgtgtag

SEQ ID NO: 56005 - DNA, 648 bp, Artificial Sequence
  Description of Artificial Sequence: Synthetic coding sequence
atggctccttgggctttattaagcccaggcgttttagtcagaaccggccacacagtcctgacctggggaattactctggtcttgttcctgcacgacacggagttgcgacaatgggaagagcaaggcgagctgttgctcccactaacttttctgctgcttgtgctcggatccttattactgtatctggccgtctcactcatggatccagggtacgtgaacgttcagccccagcctcaggaggagctgaaagaggaacaaactgccatggtaccacccgctattcccttacggagatgtaggtattgtttagtgcttcagccactgcgggcacgccattgccgggagtgtaggaggtgcgttcgaaggtacgaccaccattgtccttggatggagaattgcgtgggtgagcgaaaccatccattatttgttgtctaccttgccctacagcttgttgtgctcctctggggactttatctggcttggtccggtctgaggttcttccagccgtggggacagtggttgcggagcagtggtttgctatttgcgactttcttgctactctcacacttcttttgtggctggccttccgggtcttgggagacactatgggccgaagaagaagaggaggggagcagccctgccgtatag

SEQ ID NO: 56006 - DNA, 633 bp, Artificial Sequence
  Description of Artificial Sequence: Synthetic coding sequence
atggcaccctgggccttactctccccgggtgtcctggttcggacaggccacaccgttctgacatggggcattactctggtgttgtttctccacgatacagacaagtcagccgatgaactcctagccacacattcacattcatggaaccagcacctccaagcatttgcacagcccggtacccattttcccacctctaattgcacccccactccaccaactcctgtcctccccggacccgcttccctttgctccccagctagtcctgaactgcgacagtgggaggaacagggagagctgctgcttcccctgacctttcttctactagtattgggcagcctgttactgtatctggccgtcagcttgatggatcccggatacgtgaatgtgcaaccccagccacaagaggagctgaaggaggagcagacagcaatggtcccaccagccattcccctccggagatgcagatattgcctggtgctacagcccttgcgcgctcgccattgccgcgaatgtagacggtgcgtgaggaggtatgatcaccattgcccttggatggagaactgcgttggcgaaaggaatcatcctctattcgtggtctatctggccctacaactggtagtcctgctctggtag

SEQ ID NO: 56007 - DNA, 618 bp, Artificial Sequence
  Description of Artificial Sequence: Synthetic coding sequence
atggcgccatgggccctgctctctccgggtgtgttagttaggactggacacaccgttttgacatgggggattacccttgtcttatttctgcatgatacagagctgcgccaatgggaagagcaaggggagttgctgctacccctgacgttccttctgttggtattgggatccttgctcctctacctcgctgtgtcacttatggatccgggatatgtgaatgtgcagcctcagccacaggaggaattgaaggaggagcagaccgcaatggtgccaccagcaatccctcttcgcagatgtagatattgtctcgtgctccagcctcttagggcccgacattgtagagagtgtcgcagatgcgtgaggcgttatgaccatcattgtccctggatggagaactgtgttggcgagaggaaccacccattatttgtggtttacctcgctttacagcttgtggtgctcttgtggggactttaccttgcatgtacccgcccactttctccagcgcctcaggtgcgccctccggtgcttcctgctctgggatccgtggtggctgtgcagcgtgcaccagtacggcatctcccagctgccgtgccactgctggtaggtggccaaccctag

SEQ ID NO: 56008 - DNA, 1467 bp, Artificial Sequence
  Description of Artificial Sequence: Synthetic coding sequence
atgccaccaggtggcggtggcccaatgaaagattgtgagtactcacagatttcaacccactcgtccagtcccatggagagtccccataaaaagaaaaagatcgcagctcgcaggaagtgggaggtctttccgggacgaaacaagttcttttgtaatggacggatcatgatggcccgacagaccggagtgttctatttgaccctggtccttatattggtcacttcgggtctgttcttcgccttcgactgcccctacttagctgtgaagatcactcctgcaatacctgccgttgcgggtattctgtttttcttcgttatgggcacactgctacgcacttccttttctgatccaggtgtgctgccacgcgctacccctgacgaagccgcagacctggagaggcagatcgatatcgcaaatggcacctcaagtgggggatatagacctccacccaggacaaaagaggtgattattaatgggcagactgtaaaattaaagtactgctttacttgcaagatctttagacctccaagggcttcacactgttcactttgtgacaactgtgtggaaagattcgaccaccattgcccgtgggtgggtaattgtgttggaaagcgcaattatagattcttttacatgtttatcctgtcactgagcttcttaaccgtgtttatcttcgcgtttgtcattacccacgttatactcagatctcagcagactggctttttgaatgccttaaaagatagtccagcatccgtgctagaggccgtggtgtgctttttctccgtgtggtcgattgtcggcctgagtggcttccatacatacctcatcagctccaaccaaaccaccaacgaggatatcaagggcagctggagcaataaaaggggtaaagagaactacaatccgtacagctacggtaacattttcaccaactgttgcgtggccctctgcggccctatctctccatccttaatcgaccggagaggctacattcagccagacactcctcagcctgctgcaccttcaaacggaattactatgtatggagctacacagagccagtccgatatgtgcgatcaggatcagtgcatccaaagtacaaaatttgtgctccaagccgctgctactcccttactgcagtccgaacctagccttacctcagacgagcttcacctgccagggaagcctggcctcgggaccccatgtgccagtctgacactcggcccaccaactcctcccgcaagcatgccaaacctcgcagaggcaaccctcgctgacgtgatgccacgaaaggacgagcatatggggcaccagtttctgacccccgacgaggccccatcaccgccaaggctgttggccgctgggtccccgctggcccacagccgaacaatgcatgtgcttggtctggccagccaggactcacttcacgaagactccgtcagggggctggttaagctgtcatctgtgtag

SEQ ID NO: 56009 - DNA, 1422 bp, Artificial Sequence
  Description of Artificial Sequence: Synthetic coding sequence
atgcccccaggaggaggaggccctatgaaagactgcgagtactcccagattagtacacattcttcctccccaatggaatcacctcacaagaagaagaaaatcgctgcccgacgcaagtgggaggtctttcctggacgtaacaaatttttttgtaacggtcgtattatgatggcccgtcagaccggcgtcttctatctgaccctggtgctaattctcgtgacttctgggctgttcttcgcctttgactgcccctatttggctgtgaaaatcacacctgccatccccgcagtggccggtatccttttttttttcgtcatgggtactctcttgaggacttccttttcagacccgggtgtgctccctagagccacacccgacgaagctgccgacctggagcgtcagatagacattgccaatgggaccagttccgggggatatagaccaccaccaaggacgaaagaggtaattataaatggtcagacagtgaaactgaagtattgctttacatgcaaaatctttaggccgccaagggccagccattgcagtttatgcgacaattgcgttgaaaggttcgaccatcactgcccctgggtgggaaactgtgtaggaaaacgaaattaccgcttcttttatatgtttatattgtctctgagtttccttacggtcttcattttcgcttttgttataacccatgtgatcctgcggtcacagcagactggctttctgaacgccctgaaagacagtccagccagcgtcctggaggctgtcgtctgcttttttagtgtgtggtctatcgtgggtcttagtggatttcacacatacttgatttcaagcaaccagactactaatgaagacataaaaggctcgtggagcaataaaagaggtaaagagaattataatccttatagctacggaaatatattcacgaattgttgcgtggcactgtgtgggccaatatctccaagcctgatagaccgacgcggttatatccagcccgacaccccacagcctgctgcccctagtaacggaattacgatgtacggagccacacagtcacagtcagatatggcagccgctactcccctgcttcagtctgagccatccttaacgtccgacgagctgcatctgccgggaaaacctggccttggcacaccctgcgcatcactcactttgggaccaccgacaccccctgcttccatgcctaaccttgccgaggctaccctagccgacgtcatgccccgaaaggacgagcatatgggacaccagtttctgactcccgacgaagcaccctctccccctagattgttagcggctgggagtcctctggctcattctcgcaccatgcatgtgctgggtcttgcatctcaggacagtttgcatgaagactctgttaggggcctggtcaagctttcttctgtatag

SEQ ID NO: 56010 - DNA, 1479 bp, Artificial Sequence
  Description of Artificial Sequence: Synthetic coding sequence
gaagttgctccggaggaggccggtggcggaggacccatgaaggattgcgaatacagccagataagtactcacagcagcagccccatggaatcccctcataaaaaaaagaaaatcgctgcgaggcggaaatgggaagtattcccgggaaggaacaagtttttctgcaacgggcgaattatgatggccaggcagacaggggtcttctatcttactctcgtcttgattcttgttacaagtggcctctttttcgcgtttgactgtccatacttggcggttaaaatcacgcctgccattcccgctgttgcgggaattttgtttttcttcgtcatggggacactgctccgcacatcgttttccgatcctggagtcctcccacgggcaactccagacgaagccgctgacctcgagaggcagatcgacatcgcaaacggaactagttccgggggatataggccccctcctaggactaaggaagtgattattaacggccagacagttaagctgaagtattgtttcacctgtaaaatcttccgacccccaagggcttcacattgctccctttgcgacaattgcgtagaacggtttgaccatcattgcccttgggtcggcaattgtgtggggaaaaggaattatcggttcttctacatgtttatcttgagcctgtcctttctgacagtgtttatattcgcgttcgtgataacccatgtgatccttaggtcccagcagactggattcctgaatgctctgaaggattcccctgcttccgttcttgaggctgtagtgtgctttttctccgtctggtccatcgtggggttgtctggcttccacacatacctgatctcttccaatcagactactaacgaggacattaagggcagttggtctaataagcgcggaaaggaaaactacaacccctatagttatggcaacatcttcacaaattgttgcgtggctctttgcgggcctatttcccctagcctgattgaccggcgaggttatattcagccagatactccccagcccgcagctccctccaatggtattacaatgtacggggcaacccagagccagtccgatatgtgcgaccaagaccagtgcatccagtccaccaagttcgtgctacaagccgcagctacaccattgttgcaatcagagccctcccttacatcagacgaactccacctacctgggaaaccaggactggggaccccatgcgcatccctgaccctgggccctccaacaccacccgctagtatgccgaacttggctgaagccacactagctgacgtgatgccccgtaaagacgagcatatgggtcaccaattcctgaccccggacgaggccccttcacctccccgactgttggccgctggatcccccctggcccatagccgcacaatgcatgtcctgggcctagcctcccaggactccctgcacgaagattctgtgagaggtttggttaaattatcctctgtctag

SEQ ID NO: 56011 - DNA, 891 bp, Artificial Sequence
  Description of Artificial Sequence: Synthetic coding sequence
atgcggggacagagatcgctgttactgggccctgccagactctgcctccggctgctgctgcttttgggttaccggaggcgctgcccacccctgttgcggggactggtgcagcggtggcggtacgggaaagtctgcctccgcagcctgctgtacaactccttcggcggatccgatactgccgttgatgctgcatttgaacctgtctactggctcgtcgacaatgtcatacggtggttcggcgtcgggagaaatgacatcgcaaccgtgtcaatttgtaagaaatgtatttacccaaagcctgcgagaacccaccattgctccatctgtaatcggtgtgttttaaaaatggaccaccactgcccctggctgaataactgcgtggggcattacaatcaccgttactttttcagcttctgcttcttcatgactttagggtgcgtgtactgtagctacggctcttgggacctatttagggaggcatacgctgcaattgaaacttaccatcaaacgcccccacccacgtttagctttagggagcgtatgacccacaaaagcttagtctacctgtggtttttatgcagttctgtggctctggctttgggggctcttactgtgtggcacgctgtactgatttctaggggagagacatccatagaaaggcatattaataagaaggaaaggaggcgcctgcaggccaagggaagagtctttagaaacccatataattatggctgtctggacaattggaaagtctttctcggcgtggacacaggcagacactggcttaccagagtgttgttgccaagctcacatcttccacacggcaacggtatgagctgggaaccacctccctgggttaccgctcatagtgcttcggtgatggcggtttag

SEQ ID NO: 56012 - DNA, 1086 bp, Artificial Sequence
  Description of Artificial Sequence: Synthetic coding sequence
atgagggggcagcgcagtttactgctcggacccgcacgcctgtgcctgcggcttctgctgcttctcgggtataggcgcagatgccctcctctgcttcgtggactggtccagagatggagatatggcaaagtctgcctgcggtcactgctgtataatagcttcgggggatctgacactgccgtcgatgcagccttcgagcctgtgtactggttggtcgacaatgtgattcggtggtttggagtggtgtttgtcgtgctggtgatagtactcaccgggagtattgtggccatcgcttatctctgcgtgctcccactgatcctgcggacttattcagtgccacgcctttgctggcattttttctacagccactggaatttgattctaatcgtgttccactattatcaagcaattactaccccccctgggtaccctcctcagggccgaaatgatattgcgaccgtgagcatctgcaagaagtgcatttatcctaaacctgcgagaacccaccactgctcaatctgcaacaggtgcgtcctgaagatggatcatcattgcccgtggctgaataactgtgtgggacactataatcacaggtactttttctctttttgcttcttcatgactctagggtgcgtttactgctcctatgggtcctgggatctgttcagagaagcttacgctgctattgagacctatcaccaaacgccccctcccacattttcatttagagagcgtatgactcacaagagcctggtgtatctgtggtttttgtgtagttcagtggcgctggctttaggggctctgactgtgtggcatgccgtgctgatctccaggggagaaacctctatcgagcgtcatatcaacaaaaaggagaggcgcagattacaggctaaagggagagtgtttcgtaacccctataattacggatgtctcgataactggaaggtatttctgggggtggacacggggagacattggctgacaagagtgctcctacctagttcccatttaccccacggaaacggcatgtcttgggagccccctccttgggtgacggcccacagcgcttctgtgatggcagtctag

SEQ ID NO: 56013 - DNA, 1017 bp, Artificial Sequence
  Description of Artificial Sequence: Synthetic coding sequence
atgagaggtcaacggtccttgttgctcggaccagctagactctgtctcaggcttctgctgctcctgggctatcgacgacggtgtcctccactcctgcgcggactggtgcagaggtggagatacggcaaggtctgtttgagatcgcttttatacaattcattcgggggttcagacacagctgtggatgccgcatttgaaccggtatactggctcgtggacaacgtgatccggtggtttggtgtggtctttgtggtgctggtgattgtattaaccggcagtatcgtggctattgcttacctgtgtgtgctcccattaatcctccggacctatagcgtgcctcgactgtgctggcacttcttttactcacattggaatctcattctcatcgtttttcactactaccaggccataactacaccaccaggttatcctcctcaaggtcggaacgacatcgcaaccgttagcatctgtaaaaaatgtatttatcccaagccggctcgcacacaccattgctcaatttgtaacagttatggtagttgggatttgttccgggaagcatacgcagccatcgagaaaatgaagcagcttgataagaacaaactgcaggccgtggcgaatcagacgtatcaccagacgcccccaccgactttcagctttagggaacgcatgacgcacaagtcattggtctacctgtggttcttgtgctcatctgttgcactggcactcggtgccctgaccgtctggcacgctgtgctgatctctagaggcgagacaagcatcgagcgtcacattaacaaaaaggaacgacgaagattacaggcgaaggggagagtcttccgtaatccgtacaactacggctgcctggacaactggaaggtcttccttggtgtcgacaccggccgacactggctaactagagttcttcttccctcaagccacttgccgcacgggaatggcatgtcttgggaaccgccaccttgggtgactgctcactcggccagcgtgatggcagtctag

SEQ ID NO: 56014 - DNA, 1086 bp, Artificial Sequence
  Description of Artificial Sequence: Synthetic coding sequence
atgaggggccagaggtctctacttcttggacctgctagactgtgtctgcgactcctgcttctccttggctacagacgcagatgtcctcctctcctgcgtggccttgtgcagcgttggaggtatggcaaggtatgcctcaggagtctactttacaattcgttcggaggctcggatactgctgtggacgcagctttcgaacccgtctactggctggtagataacgtcatcaggtggtttggcgtggtgttcgtcgtgctcgtgattgtcctaacgggaagtattgtggccatcgcatacctgtgcgtgctgcctctcatactccgaacatattcagtccctcggctttgctggcattttttttactcccattggaacctgattctcattgtgtttcactactaccaggctatcacgactcctccaggttacccaccccaaggcagaaacgacattgccacggtgtcaatttgtaaaaagtgcatttatccgaagccagcccgaactcaccattgttctatctgtaatcgctgcgtgttgaagatggatcaccactgcccctggctcaacaactgtgtgggtcactacaaccaccggtatttcttttcgttttgtttcttcatgaccctgggctgtgtctattgttcttatggcagctgggatctctttcgcgaagcttatgctgcgattgagacgtatcaccagaccccacctccgacatttagtttcagagaacgcatgacccacaagagcctcgtatacctgtggtttctctgctcatccgttgctctcgccctaggggctctgaccgtatggcacgccgttctcatcagtagaggtgagacctctatcgagagacatataaacaagaaggagaggaggcggttgcaggcaaagggtcgggtgtttcggaatccctacaactacggttgtctcgacaattggaaagtgttcctgggagtggacactggtaggcactggctcacaagagttctcctacccagttcacatttacctcatgggaacggcatgtcttgggagcctcccccttgggtaacagctcactcagcgtccgtgatggctgtgtag

SEQ ID NO: 56015 - DNA, 924 bp, Artificial Sequence
  Description of Artificial Sequence: Synthetic coding sequence
atgaggggtcagcggagcctgctgctgggccctgcccgtctatgccttagactgctgttgcttctggggtaccgcaggagatgtcctcccttactccgtgggctagtacagagatggagatacggaaaggtctgcctgcggagtcttttatataattcctttggcggatcagatactgccgtcgacgccgcttttgaacctgtctactggctggtcgataacgtgattaggtggtttggcgtagtgtttgtggtgctggtcattgtgttgactggctctattgtcgctatcgcttacctgtgcgtgctacccctaatcttgcgcacctactcagtgcccaggctgtgctggcactttttttacagccattggaacctcatcctcattgtgttccattattaccaggcaattacaacgcctcctggatatcctccccaagggaggaatgatattgctacagttagtatctgcaaaaaatgcatttaccccaaacctgcccgaacacatcactgttccatctgcaaccgctgcgtcctaaaaatggaccaccattgccatatattacctccagcccttagcaaactgcccacaagccttcgtcccagcttcctctccagcgtagccttggctttgggcgcactgacggtctggcacgccgtgctgatctctcgcggagagaccagtattgagcgccacattaacaagaaagagagaaggcggttgcaggcgaaaggcagggtattcagaaatccatacaattatgggtgccttgacaattggaaagtgtttcttggcgtggacacaggtcgccactggctcacccgcgtgctcttaccatcatcgcatctgccccatggcaatggaatgagctgggaaccaccaccgtgggtgactgctcacagtgcttccgtgatggccgtgtag

SEQ ID NO: 56016 - DNA, 1134 bp, Artificial Sequence
  Description of Artificial Sequence: Synthetic coding sequence
atgcggggacagcggagcctccttctaggtcccgcaaggctgtgcctacgtctcctgctcctgcttggctaccgtaggcggtgcccgcctttgctgcgcggattggtccaaaggtggcggtatggaaaggtgtgcctgcgatcccttttgtataactcatttggaggttcggacactgccgtggacgctgccttcgagccggtgtactggctggtggacaacgtcattcggtggttcggcgtcgtgtttgtggtgctggttatcgtgctcaccggcagcatagtggctatagcctacttgtgtgtgctgccactgatcttgcgtacatattctgtcccgaggttgtgctggcactttttttatagccattggaacctgatcctcatcgtctttcactattaccaggcgatcaccacaccgccaggctatcctccacagggcagaaacgatatagcaaccgtcagtatctgtaaaaaatgtatttatcctaaacccgctaggacacaccattgctccatctgtaatagatgtgtattgaagatggaccatcattgtccatggctcaataattgtgtcggccactacaaccatcggtatttcttctccttctgcttcttcatgactctcggttgcgtatattgctcctacggatcttgggacctgtttcgggaagcatacgccgctatcgagaaaatgaaacaattggataagaacaagctgcaggctgtggcaaatcagacctaccaccaaacacccccacccacattttctttccgcgagcgcatgacgcacaaaagtctggtatacctttggttcctgtgcagttctgtggcccttgcactgggcgcactgaccgtctggcatgccgtcttaatttcccgcggtgagactagtatcgaacgccacatcaataaaaaggagcgcagacggcttcaggccaaagggagggtgtttcgaaatccttacaactatggatgtctggacaactggaaggtctttctaggtgtggacactggtcgtcactggctaactagagtcctgcttccttcctctcatctacctcacggtaacggtatgtcctgggagccccctccctgggtgacagctcacagtgcctcagtgatggcagtgtag

SEQ ID NO: 56017 - DNA, 1134 bp, Artificial Sequence
  Description of Artificial Sequence: Synthetic coding sequence
atgcgtgggcaaagatcactcctgctggggccagcacgattgtgtttgcgactgcttcttctcctgggttaccgtcggcgatgtcctcctctcctccggggactcgtgcagcgctggcggtacggcaaagtttgcctgcggtcattactatataacagtttcggcggatcagataccgctgtggatgctgcatttgaacccgtttattggttagtcgataacgtgataagatggtttggagtggtcttcgtcgttctagtaattgtcctcactggctcaatagtggcaatcgcctacctgtgtgtgctccccctcattctgaggacgtactccgtgccaagactctgttggcacttcttctattcccattggaacttgattttgatagtctttcactactaccaggccatcactacaccaccgggttacccaccgcagggccgtaacgacatcgctaccgtttccatctgtaagaagtgtatctacccaaagccagctaggacccatcattgttctatttgtaataggtgtgtactgaagatggatcaccattgcccctggctcaataactgtgtcgggcactataatcatcggtatttcttctctttctgcttcttcatgacactggggtgcgtctattgcagctacggctcatgggatctatttagagaggcgtatgctgcgatagaaaagatgaagcagttggacaaaaataagctgcaggcggtggcaaaccaaacgtatcatcagacgccccctcctacctttagtttccgagagagaatgacccacaagagccttgtttatctctggttcttatgctcgtcagtggcactggcattaggtgcacttacagtctggcatgcagtgttgattagcagaggtgagaccagcattgagagacacattaataaaaaggaaaggaggagactccaggctaaaggtagggtgtttcgcaacccctataactacggatgcctggacaattggaaggtcttcctgggagtggatactgggagacattggctgacacgcgtgctgctgccatcctctcatttaccccatggtaatgggatgtcttgggaacctccaccttgggtgacagcacatagtgcatcagttatggctgtgtag

SEQ ID NO: 56018 - DNA, 642 bp, Artificial Sequence
  Description of Artificial Sequence: Synthetic coding sequence
atgagaggccagcgcagcctgctgctggggccagccaggctttgtttaaggctgttactactcttgggatataggcggagatgccctccacttttgcgtgggttagtccagagatggcgctatggcaaggtctgcttgcgaagcctgttgtataactcatttggcggatcggatacggccgtggatgccgcattcgagcccgtttactggctggttgataacgtgattcgatggttcggtgtggtgttcgtggtgctggtcattgtgctcacaggcagcattgtggcgatcgcttacctgtgcgttctgcctctcatcctcaggacttattcagtgcctaggctatgctggcacttcttctattcacactggaatctaatcctcatagtgtttcattactaccaggcaataactaccccccctggctaccccccacagggtcgtaatgatatagccacggtctccatctgtaaaaaatgcatctatccaaagccagccagaacccatcactgtagcatctgcaacagatgtgttttaaagatggaccaccattgtccgtggctgaacaattgcgtgggtcactataatcatcgctatttcttctcattctgctttttcatgactttaggatgcgtttattag

SEQ ID NO: 56019 - DNA, 906 bp, Artificial Sequence
  Description of Artificial Sequence: Synthetic coding sequence
tgagccgtggacgccgcattcgagccagtgtactggctggtggataatgtgattaggtggtttggggtggtgttcgtcgtgctggttatcgtgctgactggaagcattgttgccatagcttacctctgtgtcttacccttgattttgcggacctacagtgtgccccgtctgtgttggcactttttttactcccattggaacctcatattaatcgtcttccactactaccaggctattacaacaccacccggttaccccccacagggacgcaatgacatagccacagtaagcatctgcaagaagtgcatttatcccaagcccgctcgaacccaccactgctcgatctgcaatcgatgtgttctcaaaatggaccatcattgcccatggttaaataattgtgttgggcactacaaccaccggtactttttcagcttttgtttcttcatgaccttgggttgcgtctactgctcatatggatcttgggatctcttcagggaggcctacgccgcaatagagaagatgaagcagcttgacaagaacaaactgcaagctgtggcaaaccagacctaccatcagaccccccctcctactttttcatttagagagcgtatgacgcacaagagcctggtatacctctggttcctgtgttcccggggagaaacttcgattgaaagacatatcaataaaaaggagaggcgcaggcttcaggctaagggacgtgtatttcgcaacccttataactacgggtgcctggacaattggaaagttttcttaggtgtggacaccggacggcattggttgaccagggtgctgcttccatcatcccacctgccgcacggaaacggcatgagttgggagcccccaccttgggtgacagcacacagcgcatctgtcatggctgtttag

SEQ ID NO: 56020 - DNA, 960 bp, Artificial Sequence
  Description of Artificial Sequence: Synthetic coding sequence
tgacggagatgtccccctctgctgagaggactggttcagcgatggcggtatggcaaggtttgcctgaggagccttttgtacaacagctttggtggctccgataccgccgtagacgctgcctttgagccagtgtattggctggtagacaacgtgatccgatggttcggcgtggtcttcgtggtactggtcatcgtactgacaggaagtatcgtggctattgcctacctgtgtgtactgcccctaatcttaaggacttactctgtgcctaggctgtgttggcatttcttttacagtcactggaatctaattcttatcgtattccattactaccaggctatcaccacccctcctggatacccccctcaaggcaggaatgacattgctactgtgagtatctgcaaaaagtgcatctaccctaagccagctcgaactcatcattgcagtatctgcaatcggtgtgtcctgaagatggaccaccattgtccttggctcaataactgtgtgggccattataatcatcgatactttttctcattttgtttctttatgacacttgggtgtgtctattgcagctacggatcatgggacctgtttagggaggcttatgctgctattgagacttatcaccagactccgcctcctacgttttccttcagagaaagaatgacccacaagagcctggtttacttgtggttcttgtgtagtcgcggagagactagtatcgagcggcatataaataaaaaagagcggagaagactacaggccaaaggtagggtttttagaaacccgtataattacgggtgtctggataattggaaagtgttcctgggagtggatacgggtaggcattggctcaccagagtcctccttccaagcagccacctcccccacggcaacgggatgtcatgggagccacccccatgggttacggcacactcggcatccgtcatggctgtatag

SEQ ID NO: 56021 - DNA, 729 bp, Artificial Sequence
  Description of Artificial Sequence: Synthetic coding sequence
atgagaggccagagaagcttactcctaggccctgccaggctgtgtcttcgcctccttttactgctgggataccggagacgttgccccccactgctcagggggctcgttcaacgatggagatacggtaaagtgtgcttaagatctctcctgtacaattccttcgggggttcagatacggctgtggacgcagcattcgaacctgtctattggctcgtcgataatgtcattcgctggttcggagtcggtcgtaacgacatcgcaacagtaagcatctgcaaaaagtgcatctaccccaagcccgcacgtacacatcactgcagcatctgtaacaggtgtgtgctgaaaatggaccaccactgcccctggttaaacaactgcgtagggcattacaatcatcgatactttttcagtttctgcttttttatgaccctgggatgtgtttactgctcatatgggtcctgggatttattcagagaggcttatgccgctatcgaaaagatgaaacaactggataagaacaagctgcaggccgtggcaaaccaaacttatcaccagactccaccccctacattctcgttccgcgagcgcatgacgcacaagtctttggtatatctgtggttcttgtgtagttccgtagcactcgcactcggtgccctgacagtgtggcacgctgtgcttattagccggggagagactagcatcgagaggcatataaataagaaggagtag

SEQ ID NO: 56022 - DNA, 1167 bp, Artificial Sequence
  Description of Artificial Sequence: Synthetic coding sequence
atgaaggattgtgagtaccagcagatctctccaggggctgcgcctctccctgcgtcccccggtgctcgcaggccagggccagccgcatcccccacaccaggcccaggacccgcaccgccagcagctcccgcaccacctcgatggtcctccagtggtagtgggtcgggctccggctctggctcacttggaagacgcccacgccgaaagtgggaggttttccctggccgtaatcggttttactgcgggggtagactgatgctagcagggcatgggggtgtcttcgcccttaccctcctgctgattcttaccactacaggcctgttttttgtctttgattgcccctatctcgcacgcaagctgactctggcaatcccaattatcgctgccatcctgttttttttcgtcatgtcctgtcttctgcagacttcgtttacggacccgggaattctcccacgggcaactgtttgtgaggccgctgccctggagaaacagatagataatacgggatccagcacctatcgccctcctcctcgaacgcgcgaagtgctgataaatgggcagatggtcaagttgaagtactgtttcacttgcaaaatgtttcgaccaccccgaacttctcactgctccgtatgtgacaactgcgtcgaaagattcgatcatcattgcccctgggtgggcaactgtgtagggagacggaattatagatttttctatgccttcatccttagtctgagcttcctaactgcattcatatttgcttgcgtcgtgactcaccttacactgagggctcagggaagcaacttcttaagcacacttaaggagactccggcatccgtgctcgagctcgttatttgtttcttttctatttggtcaatactgggtctgtctggattccacacatatctagtcgccagtaacctcaccactaatgaggacatcaagggcagttggagttctaagagaggcggtgaagcttcagtgaacccatacagtcacaaatcaatcatcacaaattgctgcgccgtgctttgcggacccttgcctccctccctcatcgacagacggggatttgtacaatcagacacggtgctgcccagccccattaggtcagatgaaccagcctgccgcgcaaagccggatgcgtccatggtggggggtcacccgtag

SEQ ID NO: 56023 - DNA, 930 bp, Artificial Sequence
  Description of Artificial Sequence: Synthetic coding sequence
atgacgctgctcacagatgccactccgttggtcaaggaacctcacccacttccgcttgtaccacggccttggtttctccccagcctgtttgccgctttcaatgtcgtgctgctcgtgttcttttctgggctgttttttgcatttccttgtcggtggcttgcccagaacggtgagtgggccttcccggttataacaggatccttgttcgtcctgacttttttttccctcgtctcgcttaactttagcgacccgggaattttgcaccagggatcagcagaacagggccctctgacagttcatgtggtgtgggtcaaccatggtgctttccgtctccagtggtgccccaagtgttgctttcaccggccacctcggacataccattgcccttggtgcaatatctgcgtcgaagactttgaccatcactgcaaatgggtcaataactgcataggtcatcgcaacttccggttcttcatgctgctcgtgctctccctttgtctttacagcggcgcaatgttggtaacatgtctcatctttctggttcgaacaacccatctgccttttagcactgacaaagctatcgccatcgtggtggcagtttctgccgcaggcttgctggtccctctgtctctgctgctcttgattcaggcactctctgtctctagcgcggacaggacctataaagggaaatgccgccacctgcaggggtacaatccctttgaccagggatgtgcctctaattggtatctgaccatatgcgcccctctgggcccaaaatacatggctgaagctgtgcagcttcagcgcgtggtaggtcccgattggacttcgatgcctaacctgcaccctcctatgtccccctcagccctcaacccgccagcacccacgagcggatctttacagagtagggaaggtacgcccggtgcatggtag

SEQ ID NO: 56024 - DNA, 1104 bp, Artificial Sequence
  Description of Artificial Sequence: Synthetic coding sequence
atggctccttccggccctggcagttcagcccgtaggaggtgtcggagagtgctgtattggattcctgtcgtgttcattactcttttgttaggatggtcctactatgcttatgctatccaactgtgcatcgtgtccatggagaacacaggagagcaggtggtatgcctgatggcttatcatctgctcttcgctatgttcgtgtggagttactggaagaccatatttacactgcctatgaacccctccaaagaattccatctgagctacgccgaaaaggacctgctggagagggagccacggggagaagcccaccaggaggttctccggagagctgctaaagatctgcccatatacactcgaaccatgtcaggcgctattcggtattgcgataggtgccagctgattaagcctgacaggtgccaccattgtagtgtctgtgacaaatgcatcctgaaaatggaccatcattgcccttgggtgaataattgcgttggattcagtaattacaaattcttcctgctgtttctggcttatagcctcttgtactgtctcttcatcgctgctacagatctgcagtatttcattaaattctggacaaacggactgccagatacccaggcaaagtttcatatcatgttcctgttctttgccgcagctatgttttccgtatctctaagcagtttgtttggttatcattgctggctggtttctaaaaataagtccactcttgaggctttccgatccccggtcttccggcacggcactgacaagaacggcttctctcttggcttctcgaagaacatgagacaggtgttcggggacgaaaaaaaatactggctactgcccattttttcctctctcggtgatggttgttctttcccaacatgtctggtaaaccaagaccctgagcaggcctctacccctgccggtctcaactcgaccgctaagaacttagaaaaccatcagttcccagcaaagcctttgcgagagtcccagtcccatctcctgaccgattctcagagctggactgagagtagcatcaatcccggaaagtgcaaagccggtatgtcaaatccggcactaactatggagaatgagacctag

SEQ ID NO: 56025 - DNA, 963 bp, Artificial Sequence
  Description of Artificial Sequence: Synthetic coding sequence
atggccccatggacgctgtggcggtgctgtcagcgggtggtgggttgggttcccgtacttttcataacctttgtggtggtgtggagttactatgcctacgtggtcgaactctgcgtgttcactatcttcgggaacgaggagaacggcaagactgtggtctatctggtggcattccatctgtttttcgtgatgtttgtctggtcttactggatgacaattttcacatcccctgcttccccttcgaaagagttctacctctcaaactcagagaaggagagatacgagaaagagttcagccaagaacgccagcaggagattctgaggagagctgcccgagctttacccatctatacaacatctgctagcaaaaccatcagatattgcgagaaatgtcagctcatcaagcccgatcgtgcccaccattgctctgcttgcgatagctgtatactaaagatggaccaccactgtccgtgggtgaacaactgcgtagggttttcaaactataaattttttctgctgttccttctttacagtctcctctattgtttgtttgtcgctgccacagtgctcgaatacttcatcaaattctggacaaatgagctcaccgacacacgtgcaaaattccatgttcttttcttatttttcgtctctgctatgttcttcatctcagtgttgtctctcttttcttaccattgttggctcgtgggaaagaataggacaaccattgaatcattcagagccccaacatttagctacgggccagatggcaatggtttctcgctggggtgttccaagaattggagacaagtattcggcgacgaaaagaaatactggctcctgccgatatttagttcattgggcgacggctgcagctttccgacacgtcttgtaggaatggatccggagcaggccagcgttaccaaccagaatgagtatgccagacgcagtaagcttcagaggtag

SEQ ID NO: 56026 - DNA, 1065 bp, Artificial Sequence
  Description of Artificial Sequence: Synthetic coding sequence
atggctccctggaccttgtggcgctgttgtcagcgtgtcgtggggtgggtacccgtactgtttatcaccttcgtcgttgtttggtcctactacgcctatgtagtggagctctgcgtgtttaccattttcggcaatgaggaaaacggcaagacagtcgtttacttggtggcattccacctgttctttgtgatgttcgtttggagctattggatgaccatcttcacttcccccgctagtccaagcaaggaattttatctgagcaattccgagaaagagcgatatgaaaaggaattttcacaggagcggcagcaagagatactgcgcagagctgcaagggctctgcccatctatactactagtgcctcgaagactattcgatattgtgaaaagtgccaattgattaagcctgaccgagcccatcactgctcggcatgtgactcctgtatccttaaaatggatcaccattgtccttgggttaacaattgtgtcggtttttcaaattacaagttttttctgttattcttactgtacagcttgctgtactgcctgttcgtcgctgctacagtgctggagtactttatcaagttttggacgaacgagctgacggacacaagggcgaaattccatgtgctgtttttgtttttcgtttctgcaatgtttttcatatccgtactatctctgttttcctatcattgttggctcgttggcaaaaatcggaccacgattgaaagcttccgagcgccaacgtttagctacggaccagacggaaatgggtttagcctcggatgctcaaagaactggcgacaggtgtttggtgatgaaaaaaagtactggttattgcccatcttctcaagtctgggcgatggttgcagcttccccacacggctggtgggcatggatcccgaacaggcctccgttacgaaccagaacgaatatgctcgcagcggtagcaaccagccctttcctatcaagccattgtctgaatctaaaaacaggctgttggattctgaaagccagtggctggagaatggagcagaagagggcatcgtgaagtccggagtgtag

SEQ ID NO: 56027 - DNA, 1098 bp, Artificial Sequence
  Description of Artificial Sequence: Synthetic coding sequence
atggccccttggactctgtggagatgttgccaacgcgtcgtggggtgggtgccagtacttttcatcacatttgtggtggtctggagttattatgcctacgtggtagaactctgcgtgtttactatttttgggaacgaggagaacggcaagacagtagtgtatcttgtcgcattccacctgttctttgttatgttcgtgtggtcctattggatgacaatattcacgtcaccagcctccccttcaaaggaattctacctgtcaaactccgaaaaagagaggtatgagaaggagtttagtcaggaaagacagcaggaaattctccggcgagcggctagggccctgcccatctataccacaagcgcttccaaaaccatccgctactgcgagaagtgtcagttgattaagcctgatcgggcacaccactgtagcgcttgcgatagctgcattttaaaaatggatcatcattgcccctgggtcaacaattgcgtcgggtttagcaactacaagttctttctcctgtttctgttgtatagcctgctttactgcctgtttgtagctgccaccgtgctcgaatacttcattaaattctggaccaacgagctcaccgacactagagctaagttccacgtcctgtttctattttttgtctctgctatgttttttatttctgtactgtccctttttagttatcactgctggcttgtgggcaaaaacaggaccacgattgaatccttccgcgctccaaccttctcttacggtcctgacggcaacggcttctcacttggttgcagcaagaattggcgacaggtttttggggacgagaaaaaatactggctgctacctatcttcagcagcctgggcgacgggtgttctttccccaccagacttgtcggtatggatcccgagcaggcatctgtgactaatcagaacgaatatgcaaggagcagtggcagcaatcagccatttcccattaaacccctttctgaatccaaaaaccggctcttggatagtgaatcacagtggttggaaaatggcgctgaggagggaattgtgaagtccggtactaacaaccacgtaactgtggctatcgaaaattag

SEQ ID NO: 56028 - DNA, 1098 bp, Artificial Sequence
  Description of Artificial Sequence: Synthetic coding sequence
atggctccatggaccctgtggaggtgctgtcagcgagtggtcgggtgggtgcctgtgcttttcatcaccttcgtggtcgtgtggtcttattatgcctacgttgttgaactgtgcgtgtttactatttttggaaacgaagagaatgggaaaactgtagtgtatctggtcgcttttcatttattctttgtgatgtttgtctggtcctattggatgacaatttttactagcccagcttccccaagtaaagagttctatctttcaaacagtgaaaaggagcgttatgagaaagaattttctcaagagcgtcaacaggagatcctccggagagctgccagagccctccccatctatacaactagcgcatccaagaccatccggtattgcgaaaaatgtcagcttattaagcccgaccgtgctcatcactgcagtgcgtgcgactcatgtattctcaaaatggaccatcactgtccatgggtgaacaactgcgttggattctccaactataagtttttcctcctgtttttactgtattcgctgctgtactgcctcttcgttgcggctacagtgcttgaatactttatcaagttctggactaatgaactcaccgatactcgcgctaaattccacgttctatttctgttttttgtttctgccatgttcttcatttctgttcttagcttgttttcttaccattgttggctagtaggaaagaaccgcaccaccatcgagtcctttagggcacctactttttcatacggaccagacggcaacgggtttagcctgggttgttcgaaaaactggcgccaggtatttggagacgagaagaaatattggctattgccgattttttcatcactcggcgacggctgctcgtttcctacacgtctggtcgggatggatcccgaacaggcctcggtaaccaaccaaaatgaatatgctcgctcatccggatcaaaccagccttttcctattaaacctctgtcggaaagtaaaaacagactcttggatagtgaatctcaatggctggaaaacggcgctgaggagggtatcgtcaagagcggaactaataaccatgtcacagtggcgatagagaactag

SEQ ID NO: 56029 - DNA, 393 bp, Artificial Sequence
  Description of Artificial Sequence: Synthetic coding sequence
atggccccttggacactgtggaggtgctgccagagagtagtcggctgggtccccgtgctgttcataactttcgtggtcgtgtggtcttactacgcttacgtggtggagctctgtgtgttcacaatcttcggcaacgaggagaacggaaagaccgtcgtgtacttagtcgccttccatctgtttttcgtaatgttcgtatggagttactggatgaccatatttacttcacctgcctcgcccagtaaggagttctacctttcaaatagcgagaaagagcggtatgaaaaagagttctcgcaagagaggcagcaagagattctgaggcgcgcagcgagggcccttcctatctatacaacatccgccagcaaatctctcatgcaatccaccaagtag

SEQ ID NO: 56030 - DNA, 879 bp, Artificial Sequence
  Description of Artificial Sequence: Synthetic coding sequence
atgtttgtctggagctattggatgacaatctttacgtcacccgcatctccttcgaaggaattttacctcagtaattctgagaaagaacgctatgaaaaagagttctcgcaggagcgtcagcaggaaattttaagaagggctgccagagctttaccaatctataccacatctgcgtctaagacaatcaggtactgtgaaaaatgtcagcttatcaagccagatcgggctcatcactgttctgcctgtgacagctgcatcttaaagatggaccaccactgcccttgggtgaataattgcgtgggattcagcaactacaaatttttcttgttgttcctgctatacagcttactttattgcctctttgtcgcagcaacagtcttggagtattttattaagttctggaccaacgagctgactgatacccgggctaagtttcacgtgctgttcttattctttgtgtccgcgatgtttttcatttccgtcctgtctctgttttcctatcattgctggctggttggcaaaaatcggaccacgattgagagctttcgggctcctactttctcctacggacccgacgggaacggtttcagcctgggttgtagcaagaactggcggcaagtcttcggtgacgaaaaaaagtactggctgctgcctattttttccagcctgggggatggatgctcctttcccactcggctggtggggatggacccggaacaggccagcgttactaaccagaacgaatacgccagatcctccggatccaaccaacccttcccaatcaaacctttaagcgaaagtaaaaatcgcttactggattccgaatctcagtggttagagaacggagccgaggagggtatcgtaaaatctggggtgtag

SEQ ID NO: 56031 - DNA, 798 bp, Artificial Sequence
  Description of Artificial Sequence: Synthetic coding sequence
atggggctacggatccacttcgtagtggacccacacggatggtgctgcatggggctgattgtgtttgtgtggctgtataatatcgtgctgatccctaaaatagtgctgttcccccactacgaagaaggtcacattcccggtatcctcatcatcatattctatggaattagcatcttctgcctggtggcactggttcgcgcttcgattacagaccctgggaggctacccgaaaacccgaaaatccctcatggggaaagggaattttgggagctgtgtaataagtgtaatctcatgcgccctaagcggagccatcactgctcgcggtgtggacattgtgtacgcagaatggatcaccactgtccttggattaacaactgcgtaggcgaagacaaccattggctgtttctacagctgtgcttctacacagagctgctgacctgttatgccctgatgttctccttctgtcattattactacttcctcccgttgaaaaaacgcaatctcgacttattcgtgttccgacacgagctagccatcatgcgactcgctgctttcatgggaatcaccatgttggtggggattaccggtttgttttacacccaactgatcgggataatcaccgacacaacatccattgagaagatgtcaaattgctgcgaggacatttctcgccctaggaaaccatggcagcagaccttttccgaggttttcggcacaaggtggaagatcctgtggttcatcccttttcgccagagacagccgctgcgcgtgccctatcattttgctaatcatgtttag

SEQ ID NO: 56032 - DNA, 792 bp, Artificial Sequence
  Description of Artificial Sequence: Synthetic coding sequence
atgttggcgttgagacttcttaatgtcgtcgcgcctgcatacttcctgtgtataagtctggtgacatttgtgctgcagcttttcctgttccttcctagcatgagggaggaccccgcagcagctcgcttgttctcccccgctctgcttcatggagctttgtttctttttctgagtgcaaatgccttgggcaactatgtgcttgtgattcagaactccccagatgacctgggtgcctgtcaaggagcgagcgccaggaagactccatgccccagtcctagcacgcatttctgtcgcgtgtgtgcgcgagttaccctgcggcatgaccaccactgcttcttcactggaaactgtattgggagccgcaatatgcgcaactttgtgctgttctgtctctacacgtccctcgcgtgcttgtactctatggttgccggtgttgcttatatcagtgcagtcctctccatttcctttgctcatcctctcgcctttctgacgctgctacccacttccatctcacagttctttagcggcgctgtcctaggatcggaaatgtttgtgattctcatgctttacctgtggttcgccatcgggttggcttgtgccggattctgttgtcatcagctgcttttaattctccgagggcaaacccggcaccaggtcagaaagggcgtcgccgttagggccagaccatggagaaaaaatttgcaggaagtgttcgggaagcgttggctgttaggattactcgtgccaatgttcaatgtcggcagcgaaagcagcaagcaacaggacaagtag

SEQ ID NO: 56033 - DNA, 126 bp, Artificial Sequence
  Description of Artificial Sequence: Synthetic coding sequence
atgttggcgcttcggctgctgaacgtggttgcgcctgcttactttctgtgcatatcgcttgtgacttttgtccttcagctgttcctgttcctgcctagcatgcgcgaggatccagctgccgcatag

SEQ ID NO: 56034 - DNA, 330 bp, Artificial Sequence
  Description of Artificial Sequence: Synthetic coding sequence
atgttagctctaagactgctaaatgtggtggcaccagcctacttcttatgtattagtctggtgacattcgtgttgcaattgtttctcttcctgcctagcatgagggaagacccagctgcggctcgactgtttagccccgctttgctccacggagccctgttcctgttccttagcgccaacgcactgggtaactatgtgctcgtcatccagaacagcccggacgatctaggcgcttgtcagggcgcatctgcacgtaagacaccttgcccttcacccagtacccatttttgccgggtttgtgctcgcgtgactttaagacacgatcactag

SEQ ID NO: 56035 - DNA, 1230 bp, Artificial Sequence
  Description of Artificial Sequence: Synthetic coding sequence
atgacccagaaaggaagtatgaagccagtcaaaaaaaaaaagaccgaagagccagaactggaaccgctctgttgctgcgagtacatcgaccggaacggggagaagaaccacgtggctacctgtctatgcgactgtcaggatcttgatgagggctgcgatagatggattacttgcaaatctctccaacctgagacctgtgaacggattatggataccatctcggacaggttacggataccatggctcagaggcgctaagaaggtgaatatctctatcattccgcctctggtccttctgcctgtgtttctccacgttgcgtcctggcattttttgctcggcgttgttgtgctcactagcctgcccgtgctcgcactgtggtattattacctcacccatcgtcgcaaggagcagacacttttttttctcagccttggcctcttcagcctcggttatatgtactatgtcttcctccaagaagtcgtaccaaagggtagagtgggaccagtacagctggcagttctcacatgtggactgtttttgatcttgcttgcccttcaccgagcgaagaagaacccaggttatttgagcaatcccgcaagcggcgataggtccctcagcagctcacagctggagtgtctgagtagaaaagggcaggagaaaacgaagggttttcccggagccgatatgtcggggtccctaaacaacagaacaacaaaagacgacccaaaaggctcatccaaaatgcccgctggatctcccacaaaagccaaggaggattggtgcgcaaagtgtcagctagtgaggccggctcgcgcatggcactgcaggatctgtggaatctgtgttaggcggatggaccaccactgtgtgtggataaacagctgtgtcggtgaatctaaccatcaggccttcatactggcactgctgatctttttgctaaccagcgtatacggtataacccttaccctagatacaatttgcagggatcggagcgtttttacggccctgttttactgtcccggagtgtacgccaactatagctccgccctgagcttcacatgcgtttggtactcagtcattattacagccggaatggcatatattttcctgatccagctgatcaatatttcctacaatgtgacagaaagagaggtccaacaagccctgcggcagaaaactgggagacggctgctgtgtggattaattgtcgatacaggtcttttaggctag

SEQ ID NO: 56036 - DNA, 447 bp, Artificial Sequence
  Description of Artificial Sequence: Synthetic coding sequence
atgactcagaagggcagtatgaaacccgtcaagaagaaaaagaccgaggagcccgaacttgaacctttatgttgttgcgagtacatagaccgaaatggcgagaagaaccatgtagccacttgcctgtgcgattgccaggatcttgacgaggggtgcgaccggtggataacgtgtaagtccctccagcctgagacgtgtgaaagaattatggatacgattagtgacagactgcggataccatggctgaggggcgcaaagaaagtcaacatttccatcatcccacccttggttctactgccagtgtttctgcacgtcgcgagctggcactttctcttgggcgtggtggtgctcacctcccttccagtgctggccttatggtattactacctcacccacaggagaaaagagcagacccttttcttcttgagcctcggtctattttcttag

SEQ ID NO: 56037 - DNA, 855 bp, Artificial Sequence
  Description of Artificial Sequence: Synthetic coding sequence
atggggcaaccttgggccgcaggatccaccgacggagctccagctcaactaccattggttctgactgcgctctgggcggctgcggtcgggctcgagctcgcctatgtcctggtgctggggccaggaccgcctcccctaggtccgcttgccagagctctgcagctcgccttggccgctttccagctgctgaacctgctgggaaatgtcggcttgtttttgcgttccgacccatctatacgtggtgtcatgcttgctggtcgagggctggggcagggttgggcctactgctatcagtgccagtcacaggtgccacctaggtctggccactgttcagcctgcagggtttgcatcctgcggagagaccaccactgccggttgttgggaagatgcgtgggatttgggaattaccgcccattcctgtgtctgttgctgcatgctgccggtgtgctacttcatgtgtccgtcctgctggggccagcactgagcgctctactgagagcccacactcccctgcatatggcggcattgttgctcctgccatggctcatgcttttgaccggccgagtgtctctcgcccaatttgcacttgccttcgtcaccgacacttgtgtggctggggctttgctctgtggcgctggcctcctgtttcacggtatgctgcttcttcgtgggcagaccacctgggagtgggcacgaggccagcactcgtatgatcttgggccatgtcacaatttacaggcagctctcggacctcggtgggccctggtttggttgtggccatttttggcttctcctctgcctggcgatggcattactttccagactacagccgatgtgggacacacagcgtcctag

SEQ ID NO: 56038 - DNA, 984 bp, Artificial Sequence
  Description of Artificial Sequence: Synthetic coding sequence
atgatgctgattccaactcaccacttccgaaacattgaacggaagcccgagtacttgcagccagaaaaatgtgtccccccaccttaccctggacctgttggcacaatgtggttcatccgggatgggtgcggaattgcttgcgctatcgttacctggttcctggtgctgtatgccgagtttgtggttctgttcgtgatgctaatcccttcacgggactatgtgtacagtattattaacggcatagtgttcaacctgttggcctttctggccctcgcctcccattgccgggcaatgttgactgatccaggcgctgtgcccaaggggaacgcgacgaaggagtttatcgaatcactgcagttgaagccaggacaggtcgtttataagtgccctaagtgctgttcgattaagcctgatcgagcacaccattgttcagtgtgcaagcgatgcatcagaaaaatggaccaccactgtccttgggtgaataactgcgttggagagaacaaccagaagtacttcgtgctgttcaccatgtacattgcactcatcagtctccatgccttgatcatggtggggttccatttcctgcactgtttcgaagaggactggactacatacggacttaatcgcgaagagatggctgaaacagggatatcactgcacgaaaaaatgcagccgctcaatttctcgtccactgaatgttcctcgttctctccccctaccacagtaattttgttaatcctgttgtgttttgagggcctgctgttcctcattttcacctcagtgatgtttgggacacaggtgcattctatctgcactgacgaaaccgggattgagcagcttaaaaaggaggagcgcaggtgggccaaaaagaccaagtggatgaacatgaaagccgtgttcggtcatcctttttctctcgggtgggcttctccctttgcaactcctgatcagggaaaggccgatccctatcagtacgtggtgtag

SEQ ID NO: 56039 - DNA, 588 bp, Artificial Sequence
  Description of Artificial Sequence: Synthetic coding sequence
attaaacccgaccgggctcatcactgctcggtgtgcaaacgctgtattcgcaagatggaccaccactgtccatgggttaacaactgcgtgggagagaataatcaaaaatactttgttcttttcactatgtatatcgccctaatttctctccatgcactgatcatggtcgggttccactttctgcactgttttgaggaggattggactaaatgttcttcattttctccacccaccacagtgattctgctgatcctgctgtgctttgaaggcctcttatttctgatttttacctccgtgatgttcggcacccaagtccattcaatttgtaccgacgaaaccggaatagaaaggttgaaaaggaagaatcagcctagagaacacatgggctcctggcagtcggttaaagagacgttcggcggagacttctcacttaattggttcaaccccttcagtcggccttgtcaacccgagatcccttccgacaaggacatggtgagacaagttacgtccctttctgataccgaaacaatggaggatcctagtgaggaaactaaagacgaggattctgttgaagtcacagacgaatag

SEQ ID NO: 56040 - DNA, 900 bp, Artificial Sequence
  Description of Artificial Sequence: Synthetic coding sequence
atgatgctgatacccacacaccactttcgtaatatcgaaaggaagccggagtacctgcaaccagaaaaatgcgttcctccaccctatcccggacccgtggggaccatgtggtttatccgcgacggatgcggcatcgcttgtgccattgtgacatggttcctagtcctttatgctgaatttgtagtgctgtttgtgatgctgattccttccagggactatgtatatagtattattaacgggatcgtgttcaacttgctggccttcctggcactagcatctcattgccgggctatgctgacagaccctggtgcggttcccaagggtaacgcaacaaaagaatttatcgagtccctgcaattaaaacccggtcaggtggtgtacaagtgcccaaaatgctgctctatcaaacctgacagagcccatcattgtagcgtgtgtaaaagatgcatcaggaaaatggaccaccattgtccttgggtgaacaattgcgtgggagagaataaccagaagtatttcgtcctgtttaccatgtacatcgcgctcatcagcctgcatgccttgattatggtaggattccattttttgcactgcttcgaagaggactggaccaaatgctcctcctttagtccaccaacaacagtaattctgttgatcttgctgtgctttgaagggcttttattcctgatcttcacctcggtcatgtttgggacacaggtgcattcaatctgcactgacgagactggaatcgagcagcttaagaaggaagagcggaggtgggcgaaaaaaacaaagtggatgaacatgaaggcggtgttcgggcatccgttctctctggggtgggcaagccctttcgccactcccgatcaaggaaaagcagacccatatcagtatgtggtctag

SEQ ID NO: 56041 - DNA, 1035 bp, Artificial Sequence
  Description of Artificial Sequence: Synthetic coding sequence
atggattttctggtcctattcctcttttacctggccagtgttctaatgggcttggtactcatttgcgtctgcagcaagactcattccctcaagggcctggccagggggggagcacaaatcttttcttgcatcattcccgaatgcctacagcgggctgtgcacggtctgcttcattacctcttccacacaaggaatcacactttcatcgtgctgcacttagttctacagggcatggtatatacagagtacacttgggaggttttcggctattgccaggagttggagctttcgctgcactatctcttgttgccttacttacttcttggcgtcaatctcttcttcttcactctgacttgcggcactaatcccggaattattacaaaagctaatgaactgctgtttctgcacgtctatgagttcgatgaggtgatgtttccgaaaaatgtccggtgtagcacatgcgacctgcgtaagccagcacgatcaaagcactgtagtgtttgtaactggtgtgtacatcgctttgatcaccactgcgtatgggtgaataactgtatcggagcttggaatatccggtattttctgatctatgttctaaccctgaccgcatccgccgcaaccgttgccattgttagtacaacatttctggtgcatctcgtcgtcatgagcgatctttatcaggaaacttacatcgacgatcttggccacttgcacgtgatggacacagtcttcctgatacagtacttgttcctgacttttcctcgaattgtgttcatgcttggttttgtggtagtcctgtcctttttactggggggatacttgctgttcgtgctgtatctggcagctaccaaccagacaaccaatgaatggtataggggagactgggcatggtgtcagagatgccccctggtagcatggcctccatcagcagaaccccaagttcacagaaatatccactcccacggactgcgaagcaacttgcaggagattttcctgcccgcattcccttgtcatgaaaggaagaagcaggagtag

SEQ ID NO: 56042 - DNA, 1035 bp, Artificial Sequence
  Description of Artificial Sequence: Synthetic coding sequence
atggatttcctggtgctgttcctgttctacctggcctcggtgctgatgggtctcgtcttgatatgcgtgtgtagtaagactcacagcctcaaagggctggcaaggggcggtgcccagattttctcatgcatcatcccagaatgtttgcagagagcagtgcatggtttgctgcactacctgttccacacaagaaaccacacctttatcgtgctccacctggtcctccaggggatggtttacaccgagtacacatgggaggtctttggatactgccaggaactggaactgtccctgcattatctccttcttccttacttattgctgggcgttaacctgtttttcttcaccctgacctgtggcacaaacccagggatcattacaaaagccaacgagttgctatttctccacgtttacgagttcgacgaggtgatgtttccaaaaaatgttagatgtagtacgtgtgatctgcgcaagccagccagatcaaaacattgcagcgtatgtaattggtgcgtccatcgcttcgatcaccattgtgtttgggtgaataattgtatcggtgcctggaacattcggtactttctcatttacgtgttgactctgactgctagtgcagccactgtggccatagtctcaacaacctttctggtgcatctggtcgttatgagtgatttataccaggagacatacatcgacgatctcggacatttgcacgtgatggatactgtgttcctgatacagtatctgtttctcacttttcctcggatcgtgttcatgctagggttcgtggtggttttgtccttcttgctgggcggttacctgctcttcgtgttgtatctagcagccacaaaccaaaccacgaatgagtggtatagaggtgactgggcttggtgccaacgatgcccgctggttgcctggccccctagtgctgagccccaggttcataggaacatacactcacatgggctgcgaagcaatttgcaggagatctttttacccgcttttccttgccacgagaggaaaaagcaggagtag

SEQ ID NO: 56043 - DNA, 1035 bp, Artificial Sequence
  Description of Artificial Sequence: Synthetic coding sequence
atggattttctcgtgctgttcctgttctacctggccagtgtgctcatgggcctggttttaatctgtgtgtgttccaaaacccattccttgaagggcttagcccgtggcggagcccagattttttcatgcattattcctgaatgcctgcaaagagctgtccacggactgctgcactatctgtttcatacaagaaaccacaccttcattgtgctccatcttgtcttgcagggcatggtgtataccgaatacacatgggaagtgtttggttactgccaagagctggaactaagccttcactacctcttgctgccctacttgctgctgggcgtcaatctgttcttcttcacgctcacttgtgggaccaaccccggtatcatcacaaaagcaaatgaattattattcctgcatgtctatgagttcgacgaggtgatgttcccaaagaatgtccgatgttccacctgtgatctgcgtaaacctgctaggagtaaacattgtagtgtctgtaattggtgtgtgcaccgcttcgaccaccattgtgtatgggtgaacaactgcatcggagcttggaacatccgatactttttaatctacgttctgaccctgacagcatccgccgctacagtggctatcgtgtccaccaccttcctggtgcatctcgtcgtcatgagcgacctgtatcaggagacttatatcgatgacctgggacatctgcacgtgatggatacggttttcctgatccagtacctgtttctcacttttcccaggatcgtctttatgctggggttcgtcgttgtgctctcattccttcttggcggatatctactttttgttttatatctggctgctacgaaccagaccaccaacgaatggtatcgcggagactgggcatggtgtcaaagatgccctctagttgcctggccaccatcagccgagccacaagtgcatagaaacattcactcccatggcctgcgctcgaatttacaagagatcttcctgccagcttttccatgccacgagcgaaaaaaacaggaatag

SEQ ID NO: 56044 - DNA, 1035 bp, Artificial Sequence
  Description of Artificial Sequence: Synthetic coding sequence
atggactttctagtattgtttctgttttatctggccagtgtgctaatgggacttgtcctgatctgcgtttgttccaagacccacagtcttaaagggctggccagaggaggcgcacagattttctcttgcatcatcccagagtgtttacagagggccgttcacggtttgctccactacctgttccataccagaaaccatacattcattgtgctgcacttggttctgcaggggatggtgtacaccgagtatacatgggaagtgttcgggtactgccaggagttagagctgagtctgcactacctgctcttaccctaccttctgttgggggtcaacctcttcttctttactctgacatgtggaacgaaccccggaatcattacaaaagcaaatgagttacttttcctgcatgtgtacgagttcgacgaagtgatgtttcccaaaaacgtaaggtgctctacatgtgaccttaggaagcctgccagatcaaaacattgtagtgtctgcaactggtgcgttcaccgtttcgaccaccactgtgtgtgggttaacaactgtatcggggcttggaatatcaggtactttttaatttacgtccttacactgaccgctagtgctgcaactgttgcgattgtgtcaaccacttttctcgtgcatctcgtcgtcatgtcagatctctatcaagagacctacatcgatgatctgggtcacctgcatgtcatggatacagtgtttctgatccagtacctttttctgaccttccctcgaattgtcttcatgctgggctttgtcgtggttttgagttttctgctcgggggttaccttctgtttgtgttataccttgcagctaccaaccaaacaacaaatgaatggtacaggggagattgggcctggtgtcagcgctgtccgttggttgcgtggccaccgagcgccgaacctcaagttcacagaaacatacacagtcacggcctgcgcagcaacttgcaggagatctttcttcccgcattcccttgtcatgagaggaaaaagcaagaatag

SEQ ID NO: 56045 - DNA, 1035 bp, Artificial Sequence
  Description of Artificial Sequence: Synthetic coding sequence
atggactttctggtgctttttctcttttatctggcttccgtgcttatgggcctggtgctgatttgtgtttgttctaagacacactcactgaaaggactggccagaggcggagcccagattttctcttgtataatccctgaatgcctgcaacgcgctgtccacggattactccattatttgtttcacactcggaaccatacttttattgttctgcatttggtcctgcaaggtatggtgtacacagaatacacttgggaggtgtttggctattgtcaggagctagaactgagcttacactacctcttactgccctacctccttttgggagtgaacctctttttcttcacactaacttgcgggacaaatcccggtattataacaaaagctaatgaattgctgtttttgcatgtgtatgagtttgatgaagtgatgttccccaagaacgtaaggtgcagtacctgcgacctgcgaaagccggctcgaagtaagcattgtagcgtttgcaattggtgtgtgcatcgcttcgatcaccattgcgtctgggtaaataattgcattggggcttggaacatcaggtacttcttgatctatgtactgacattgaccgcttccgcagccacagtcgcaattgtgtctactacattcctggtacatcttgtagtaatgtcagacctataccaggaaacctatattgatgacctcggacatctgcacgtcatggacacagtatttctaatacagtaccttttccttacatttccacggatagtgttcatgctagggtttgtggtggtcctcagcttccttttagggggttatttactgttcgtgctgtatctggccgcaacaaaccagacaactaacgaatggtaccgaggagattgggcatggtgccaaaggtgtccactggtcgcttggcccccatctgccgagccccaggtgcacaggaatattcactctcacggactgcgttccaaccttcaggagatctttctacctgcctttccatgccacgagaggaaaaagcaggagtag

SEQ ID NO: 56046 - DNA, 1035 bp, Artificial Sequence
  Description of Artificial Sequence: Synthetic coding sequence
atggatttcctggtgctttttcttttctatctcgcatctgtcctgatgggactggtcctgatatgtgtgtgttcaaaaacccactctctgaaaggcttagcacggggaggggctcagatcttctcctgcatcatcccggagtgcctacaaagggcggtccatggactgctacactatctctttcatacacgcaatcacaccttcattgtgcttcacctcgtgctccaggggatggtgtacacagagtacacctgggaagtgttcgggtattgtcaggagctggagctgtccctccattatctgcttcttccctatcttctcctgggcgtgaatctgtttttttttactctgacgtgtggcacgaacccaggcataataacaaaagctaatgaactgctgttcctgcatgtgtatgagttcgatgaggtgatgttccctaagaatgtcagatgcagtacctgcgatctgcgaaaaccagcgcgttccaagcactgctctgtctgcaactggtgtgtgcacagatttgaccatcattgcgtctgggtgaataactgcattggtgcctggaatatccgttatttcctaatctacgtactcaccctaacggccagcgctgccaccgtggcaattgtcagtacgacttttctcgtgcacctagttgttatgtcagacttgtaccaggagacgtacatcgatgacctcgggcacctgcatgtgatggatacggttttcctaatccagtatctcttcctgacctttccacgaatcgtgttcatgctcgggtttgttgtggtcctgagctttctgctgggaggctatctcctgtttgttctgtatttggccgctactaaccaaacaacaaatgagtggtaccggggagattgggcctggtgtcagcgttgcccgttggtggcctggccccctagcgcagagccacaggtacacagaaatatacactcccatgggctcaggtccaatttacaggaaatcttccttccagcatttccctgccatgaacgaaagaaacaggaatag

SEQ ID NO: 56047 - DNA, 498 bp, Artificial Sequence
  Description of Artificial Sequence: Synthetic coding sequence
atggacttcttagtgttgttcctattttatctggctagtgtgctaatgggcttggtcttgatctgtgtgtgctcaaaaacacattcgctgaaaggtcttgctcgcggaggagcacagatcttctcatgcattatccctgaatgcctgcagcgcgctgtgcatggtttgctccactacttattccatactaggaatcacacattcatcgtgcttcacctagttctgcaaggcatggtttatactgaatacacctgggaagttttcggctactgtcaggagctcgagttatcgctgcactacctgctgcttccgtacctactcctcggagtgaatttattcttttttaccctgacatgcgggactaacccgggtataataactaaagcaaatgaattgctgttcctgcatgtctacgagttcgatgaggtgatgtttccgaaaaacgttcgatgcagtacttgtgacctgcggaagcccgctagaagtaagcactgttag

SEQ ID NO: 56048 - DNA, 2148 bp, Artificial Sequence
  Description of Artificial Sequence: Synthetic coding sequence
atgcctgccgaatcggggaaacggttcaagccttccaaatatgttccggtctcagcagccgctatcttcctggtcggcgctacaaccctttttttcgcctttacctgccccggtttgagtctgtatgtgtctcccgctgtgcccatctacaacgccattatgtttctgttcgtcctcgctaatttcagcatggccacttttatggatccagggatctttcctagggcagaagaagacgaggataaggaagacgacttccgcgcacctctgtacaaaacggtagagattaagggcatccaggtgcgcatgaagtggtgtgcgacgtgcagattttaccggccacctaggtgtagtcactgcagtgtttgtgacaactgtgttgaggagttcgaccatcactgtccctgggtcaataactgtatcggccgaaggaattatcgctactttttccttttcttactgtcgctgaccgctcacatcatgggggtgttcggctttgggctgctgtatgttctttaccacatcgaagagctgtctggagttcggaccgctgtcacgatggcggtgatgtgcgttgcaggcctgttcttcattccggtagcgggacttaccggcttccacgtggtcctggtcgcgcgaggtcgcacaacaaacgaacaggttacgggtaaatttcgcggtggtgttaaccctttcaccaatggttgttgtaacaacgtctcaagggtgctctgtagtagtcccgctcccaggtacctcgggagacctaaaaaggagaagacaattgtaattagaccccctttccttcgacccgaagtgtctgatggtcagattaccgtcaagattatggataatggtatacagggggagttgagaaggacgaaatccaaagggagcctggagattactgagagtcagtctgccgatgcagagcctccccctccacctaagcctgacttgagtaggtacaccggcttgaggacccatttgggcctcgccaccaacgaggactctagtcttctggctaaggactcccccccaacaccaacaatgtataagtatcgtcccggttatagtagctcttctacctccgctgcgatgccacactctagttccgccaagttatcaagaggggattcacttaaggagcctacctcaattgcggagtcatcaagacaccccagctaccggagcgaaccctccttggagcctgaaagtttccgcagcccgaccttcggcaaaagctttcattttgaccccttgtcttccgggtctagatcatccagtctcaagagtgcacagggaacagggtttgaattgggacagctgcagagtatcagatccgaaggcactaccagcacgtcctacaaatcacttgctaaccagacccgcaatggttctttgtcttatgattctcttctgactccttctgattctcctgacttcgagtctgtgcaggccggtcccgaacccgacccgccacttggttatacctctcccttcctgagtgcgcgactggcccagcagcgggaagccgaacggcatcctcggctggtacctaccgggcctacacaccgtgagcccagcccagtaaggtatgataatctatcaagacatattgtggcctcattgcaggagcgagaaaagctcctcagacagagccctcccttgcccggacgagaagaggagccgggtctgggggacagcggcattcaatcaacaccaggaagtggacatgcgccaagaacaagctctagttctgatgactctaaacgttctcccctaggtaagacccctctcggccgacctgcagtccctaggttcggcaaacctgatggcctgagaggtaggggggtcggctcaccagagccaggacccacagcgccttacctcggacgctctatgtcctacagcagccagaaagcccagccaggagtcagcgaaacagaagaggtagctttacagccattgcttacgcctaaggatgaggtgcaactgaagacaacgtactccaaaagcaatggacagcctaagtccctgggctctgccagccccggacccggtcagcccccactgagttccccaacacgaggtggcgtcaagaaagtttcaggcgtcggcggtaccacgtatgagatttccgtctag

SEQ ID NO: 56049 - DNA, 1989 bp, Artificial Sequence
  Description of Artificial Sequence: Synthetic coding sequence
atgtttctgttcgtactggctaatttttcaatggcaacgttcatggaccctggcatattcccaagagctgaagaggacgaggataaagaagatgattttcgtgcccctctatacaagactgtggaaatcaaaggcatacaggtcaggatgaaatggtgtgccacgtgcaggttctataggcctccgcgatgctctcattgttcagtctgtgacaactgcgtcgaggagttcgaccaccattgtccctgggtgaataactgcatcggaaggcgcaactatcgctacttttttctttttctgctgtcactgaccgcccacataatgggagtgtttgggttcggtctgctgtacgtcctgtaccacatcgaggagctgtctggcgtgaggacagccgtgacaatggccgtcatgtgtgtggccggactgtttttcatccccgtggccggtctaacgggttttcacgtagtgttagtggccagaggtcgaactacaaatgagcaggtcacgggaaagttcagggggggagtgaatccattcactaacggatgttgcaataacgttagccgggtactctgctcttcaccggctcccaggtatcttggacgcccaaagaaggaaaaaacaatcgtaatcagaccacccttcctgagaccagaggtaagtgatggccaaattacagtgaagatcatggacaatgggattcagggtgagttgcgtagaactaagagtaagggcagtctcgagataacggaatctcaatctgccgatgcagaacctccgccaccacccaagcccgatttgtcaaggtatacagggctcaggacacatctgggcctagcaactaatgaggactcatcactcctcgcgaaggattctcctcccactcccaccatgtataaataccggccaggctactcatcaagctcaacctccgcagccatgccacactcctcaagcgccaagcttagtaggggagacagcctgaaggagcctacaagcattgcagaatcgagcagacaccccagctaccggtctgaaccgtcattggaacctgagtcttttagaagtccaacctttggcaaaagttttcattttgatcccctgtcatcaggctctcgatctagttcattgaaatctgctcagggtacaggcttcgagctgggccagctccagtcgattcgctccgaaggcactacctccacctcctacaagagcctggccaaccagacccgtaatggatccctgagttatgattccctcctgaccccctcagacagtccagacttcgaaagcgtgcaggccggacccgagcccgatcccccactgggctatacctctccgttcctgagtgcacgtttggctcagcagagggaggccgagcggcaccctcgcctggttccgaccgggccaacgcaccgggagccctctcccgttagatatgataatctgtcccggcacatcgttgctagtctgcaggagcgggaaaagctgcttcggcagagcccgcctctccctggacgagaggaagaaccgggactcggcgactccggcatccagagtacccccggaagcgggcacgcacccagaacatctagttccagtgatgactcgaagagaagcccactgggaaaaacccctctgggtcgacctgcagtgcccagatttggcaaacccgacggactgaggggcaggggtgtgggaagtcccgagcctgggccaaccgcaccatacctaggcagatccatgtcttacagcagccagaaggcccagcccggagtctctgagacggaagaggtcgctctgcagccactgcttactccaaaagatgaggtacagttgaagaccacatatagtaagtctaacggccaaccaaaatcccttggttccgcatcccccggacctggccagccccctctgagttcccctacgcgcggaggggttaagaaagtttctggtgtgggaggcacgacatacgaaatctcagtgtag

SEQ ID NO: 56050 - DNA, 1230 bp, Artificial Sequence
  Description of Artificial Sequence: Synthetic coding sequence
atggggaccttttgctccgtcatcaagtttgagaatctccaggagctgaaacggctctgtcattgggggccaatcatcgccctcggggtcatcgccatttgttcaaccatggccatgatcgacagtgttctttggtattggcctctgcacacgacaggcggatctgttaatttcatcatgctaatcaactggacagtgatgattctgtacaactacttcaacgcaatgtttgtgggcccaggattcgtgccactggggtggaagcccgataccatgtatctccagtactgcaaagtatgccaggcctacaaggctcctagaagtcatcattgcagaaaatgtaatcgatgcgtgatgaagatggaccatcactgcccctggataaacaattgctgcggctaccagaaccacgcctctttcacccttttcctgcttttggcacccttaggctgtattcatgccgcattcatattcgtcatgacaatgtatactcagttgtatcaccgcctttccttcgggtggaatacagtgaagattgatatgtcggcagccagacgagaccccctgcctattgtgcccttcggccttgcagcgttcgcaacgacccttttcgccctgggactcgccctgggtaccaccatcgccgtcggaatgctgttctttatacagatgaagattattttacgaaataaaacctctattgagtcttggattgaggaaaaagcgaaagacaggatccagtattatcagctggatgaggtgtttgtgttcccctacgatatgggatctcggtggaggaacttcaagcaggtattcacctggtctggtgtgcccgagggtgacggtttggaatggccagtccgtgagggttgtcaccaatactctctaaccattgagcaactcaagcagaaggctgacaaaagggtgcgctctgtgaggtataaggtcattgaggattatagcggggcttgttgccccttaaacaaaggaatcaagacctttttcacctctccctgtaccgaggaaccacgaatccagttgcagaaaggcgagtttattttggccacaagaggcctccgctactggctatacggcgataagattcttgacgacagttttatcgagggcgtgtcccggattcgaggttggttccctcgcaaatgtgtagagaagtgcccatgtgacgccgagaccgatcaggcgcctgaaggagaaaaaaagaacaggtag

SEQ ID NO: 56051 - DNA, 1242 bp, Artificial Sequence
  Description of Artificial Sequence: Synthetic coding sequence
atggggacgttctgctctgtgattaagttcgagaacctgcaagagctgaaacgtctctgtcactggggtcccattatcgccctgggggtaatcgcaatatgcagcactatggctatgatcgactccgtcctctggtattggcctctccacaccacaggagggtccgtgaactttattatgttaataaactggacggtgatgattctgtacaattacttcaacgctatgttcgtcggtcccggttttgtgcccctgggctggaaaccagaaatctcccaagacacaatgtatctgcagtactgtaaagtgtgtcaggcgtataaggccccaagatcacaccactgtaggaagtgcaatcggtgcgttatgaagatggatcaccactgtccgtggatcaacaactgttgcggatatcagaaccacgcaagttttaccctttttctcctgcttgcacccctcgggtgcattcatgcagcatttattttcgtcatgaccatgtatacacagctgtatcaccgactttctttcggatggaatacagtgaagatcgacatgtcagctgcaaggagagaccctctcccaatcgtgccttttgggttagctgcctttgcaaccaccctgttcgcgctggggcttgctctcggaacaacgatcgctgttgggatgttattctttatccagatgaagattatattgcgaaacaaaaccagtattgagagctggatcgaggagaaagccaaagacagaatacagtattatcaactcgacgaggtctttgtgtttccatacgatatgggttcacgctggagaaacttcaagcaggtgttcacttggtccggggtaccagaaggggacggcctcgagtggcctgtgcgggaagggtgtcaccagtactctctaactattgagcagctgaaacagaaagcagataagcgcgtgaggtcggtccgatacaaggtgatcgaggactacagtggggcttgttgcccattgaataaaggaatcaagacttttttcacatctccttgcaccgaagagccgagaatacagttgcagaagggagaatttattctggcaacccgtggactgcgatattggttatatggtgacaagatcctcgatgactctttcattgaaggggtgtcacggattcgcggttggttcccacgcaaatgcgtcgagaagtgcccttgcgacgcagagacagatcaggctcccgaaggggaaaaaaaaaatcggtag

SEQ ID NO: 56052 - DNA, 927 bp, Artificial Sequence
  Description of Artificial Sequence: Synthetic coding sequence
atgcagccgagcggccaccgcctgcgagacgtcgaacatcatccactactggcggagaacgataactacgattcttctagctcttccagttcagaggccgacgtcgctgatcgggtttggttcatccgcgatggttgcgggatgatctgtgccgtgatgacttggctgcttgtggcttacgccgactttgtggtgacttttgtcatgctcctgccctctaaagatttttggtatagtgtggtaaatggagtgatctttaactgcctggcggtgctggccctgtcctcccacctgagaacaatgttaacagatcccggagctgtgcccaaaggcaatgctactaaggaatacatggagtcgctccaactcaaaccaggggaagtgatctacaaatgccctaagtgctgttgcatcaagccagaacgagcccatcactgctccatctgcaagcgttgcatcagaaaaatggaccatcactgcccctgggttaacaattgcgtgggcgagaagaatcaacgtttcttcgtgctctttacaatgtatatcgctctctcttctgtacacgcgctgattctctgtggtttccagttcatatcatgcgttcgaggacagtggactgagtgctcagatttctcaccacctattacagttatccttctgattttcctgtgtcttgaaggactgcttttcttcactttcaccgctgttatgttcggaacacagatccactccatctgtaatgacgagacagagatcgaaaggctgaagagtgagaaaccaacttgggaaaggcgcctgagatgggagggtatgaagagcgtgtttggaggccctcctagtctcctgtggatgaatcccttcgttgggttccgcttccgccgtcttcccacaagaccacgaaagggaggccctgagttttccgtatag

SEQ ID NO: 56053 - DNA, 1038 bp, Artificial Sequence
  Description of Artificial Sequence: Synthetic coding sequence
atgcagcctagcggacatcgactccgggatgtagaacaccatccactgctggccgaaaatgacaattatgatagcagttcatcgtctagcagtgaggctgacgtggctgatcgggtatggttcattcgtgatggttgcggcatgatctgcgcagtgatgacgtggctgctggtagcctacgcggattttgtggtgacattcgttatgctcctgccttcaaaggatttctggtattcagtagtgaatggggttattttcaattgccttgctgtgctggcgctgagcagccacctgaggacgatgctgaccgatcctgaaaagtcatctgattgtaggccatctgcttgcactgtgaagaccggcttggatcctacattggtgggcatttgcggggagggtaccgagtcagtgcagtccctgcttctgggtgccgtccccaaaggcaatgcgaccaaagaatacatggagtccttacaactgaagccaggggaagtcatctacaagtgtcccaagtgctgctgtattaaaccggaacgcgctcaccattgctctatatgcaaaagatgcatccgcaagatggaccatcactgtccctgggttaataactgtgttggagaaaaaaaccagcggttcttcgtccttttcactatgtatatcgccttatcttctgtgcacgccctgatcctttgtggctttcaatttatctcatgcgtcagaggtcagtggacagagtgcagcgacttttccccccctattactgttatcctactcatcttcctatgcctcgaggggctactgttctttacatttaccgctgtgatgtttggtacccaaattcatagcatctgtaacgatgagactgagatagagcgtctgaaatcagagaagccaacatgggagcgtaggctccgctgggaagggatgaagagtgtctttggcggtcctccttccctgctgtggatgaatcccttcgtgggatttcgcttccgtcgattgcctactagacccagaaaaggaggaccagagttcagcgtgtag

SEQ ID NO: 56054 - DNA, 4620 bp, Artificial Sequence
  Description of Artificial Sequence: Synthetic coding sequence
atggactcatattttaaggccgcagtgagcgacctagataaattgctggacgattttgagcagaaccccgatgagcaagactacttgcaggatgtccagaatgcctatgactcaaaccattgttccgtgagcagtgagctggcctcatctcaacgcacaagcctgctcccaaaagaccaagaatgcgtgaattcttgtgcaagctccgagacaagctatggcaccaacgagtccagtctcaacgaaaaaacattgaaaggcctgacatccatccagaatgagaagaacgtaaccggcctggacctgttgtcgagcgtcgacggaggaacttctgacgaaatccaaccattgtacatggggaggtgctcaaaacccatatgcgacctaatcagcgacatgggcaacctggtacacgccacaaacagcgaggaggatatcaaaaagctgttaccagacgattttaaaagcaatgccgattcactgatagggctggatttaagttccgtgtcagatactccctgcgtaagcagcactgatcacgacagcgataccgtgagagagcagcaaaatgacattagctccgagctgcaaaacagagagatcggcggtataaaggaactgggcattaaagtcgacactaccttgtccgattcctataattatagtgggacagaaaatctcaaggataagaaaatattcaaccagctggaatcaatcgttgatttcaatatgagtagcgcactgacgcggcagtcctccaagatgttccacgccaaggataagcttcagcataagtcccagccatgcggtttgctcaaagacgttggtctcgtgaaggaggaggtcgacgtggctgtgattacagcggcagaatgtctgaaggaggagggcaagacttctgcgctgacctgttcactgcctaaaaacgaagacctctgcctcaacgattctaattccagagacgaaaattttaagctccctgacttctcttttcaggaggataagacggtgattaaacaatcagcccaggaagacagcaagagtttggacctgaaagataacgatgtcatccaagattcttcctcggccttacacgtcagttctaaggatgtgccctcctccctgtcctgtttgcccgctagcggttctatgtgcggaagcctgatcgaatctaaagccagaggcgatttcctgcctcagcacgagcacaaagataacattcaggacgcagtcaccatccacgaagaaatccaaaactccgttgtgctggggggagagcccttcaaggaaaacgatctccttaagcaggagaagtgtaaatctatcttactgcagagtttaattgaaggcatggaggaccgtaagatcgaccctgaccagaccgtgattcgggctgagagcctcgacggtggggacacaagctctactgtggttgagtctcaggaagggctgagtggcactcacgttcctgagtcttccgattgttgcgagggttttattaatacattcagttctaatgatatggacggacaggatctcgactactttaacattgacgaaggggctaaaagtggcccactcataagtgacgctgagctggacgctttcctgacggaacagtacctccaaacaactaatataaagagcttcgaagagaatgtcaacgactccaaatctcagatgaaccagattgatatgaaaggcctcgacgacggcaacattaataatatttacttcaacgctgaggctggggcaattggagagagccacgggataaacatcatatgtgagattgtagataagcagaatactattgagaacggattgtcactgggtgagaaaagcaccattcccgtgcaacagggcctgccaactagtaagagcgaaattactaaccagttgtctgtatcggatattaattctcagtcagtggggggtgcgagacccaagcagctgttctctctgccaagcagaacccggagttccaaggatctgaacaaacccgatgtgcctgatactattgaatcagagccctccaccgctgatacagtggttcccattacctgtgccattgattcgactgccgatccccaggtgtccttcaactcaaattacatcgatatcgaatcgaattccgagggagggagttcattcgttaccgcaaatgaggatagtgtacccgagaatacctgcaaggagggactggtcctggggcaaaagcagcctacctgggttcctgactcggaggccccaaattgcatgaattgtcaggtcaaattcacctttacgaagcgccgtcatcattgtcgagcctgtggaaaggtcttctgtggagtttgctgcaaccgaaaatgcaagttacagtacctggagaaagaagctcgagtgtgtgttgtatgctatgagacaatctccaaggctcaagctttcgagcgcatgatgagcccaaccggctccaaccttaaaagcaatcactcagacgagtgtacaaccgtgcaacccccacaggagaaccagacaagctctattccctcaccggctacactgcccgtctccgcgcttaagcagcctggtgtggaagggctttgtagcaaagagcagaagcgtgtctggtttgccgacggcattttaccaaacggggaggtagccgataccaccaagctgagttcaggctccaagagatgcagcgaggacttctcaccactgagccctgacgtgcctatgacagtcaacacagtggaccatagccactctacaactgtagagaaaccgaacaatgagactggagacattacccgtaacgaaataattcagtctcctattagtcaagtgccaagcgtcgagaaactgagcatgaatactgggaacgaaggactccccaccagtggctcctttactcttgacgacgatgtttttgccgagaccgaggagccaagttcgccaaccggagtgctggtaaattcgaacctgcctatagcctcaatctcagactaccgcctcctgtgcgacatcaataaatacgtatgtaacaagatttctctcctgccaaatgacgaggactctctgcccccactcctggtggcgtccggagaaaaggggagtgttcccgttgtcgaggagcatcccagccacgaacagataattctcttactggagggtgagtcttttcacccagtcacatttgtgttgaacgctaatttgctggtgaacgtgaaattcattttttattcgtccgacaaatactggtacttctcaaccaatggcttacatggcctcggacaggcagaaatcattattctgcttctctgcttaccaaatgaggacacaatcccgaaggacattttccggttattcatcacaatctataaggacgcccttaagggtaaatacattgagaacctcgacaacattacctttacagagagttttctttccagtaaggaccacgggggattcctgttcattacaccaacatttcagaagttggacgaccttagtttgcctagcaatccctttctgtgtggaatacttattcaaaagttggagattccttgggccaaggtctttcctatgagactgatgctacgacttggcgctgagtacaaggcatatccggctccgttgacctccatccggggtcgcaaaccgttgttcggcgagatcgggcacacgattatgaatctgctggttgacctgcggaattaccagtataccttacataacattgaccagctgctgatacacatggaaatgggtaaatcatgtatcaagattcccaggaagaagtactccgatgttatgaaggtgctgaattctagcaatgaacatgtgatatctattggggcttccttcagcaccgaggcggattcacacctggtttgcattcaaaacgacggcatatacgaaactcaggccaactctgctaccgggcaccctaggaaagtgaccggggcttcttttgttgtgttcaatggggcattgaagacctccagtggttttctagcgaaatctagcattgtcgaagatggtctcatggtgcagattacacccgagacaatgaacggtttaaggctggcactgcgggagcagaaggattttaaaattacatgcgggaaggttgatgcagttgatctgagagaatacgtggatatctgctgggtggacgccgaggagaaaggaaacaagggcgtgatttcctccgtcgatggaatctctttacagggcttccctagcgaaaagatcaagctcgaggcagattttgagaccgatgaaaagattgttaagtgcacagaagtgttctattttctgaaggaccaggatctctccattctgagtacatcgtatcagttcgcgaaagaaatcgctatggcctgttccgcagctctatgcccacacctcaaaacactgaaatctaacggtatgaacaagattggtctgcgagtgtccattgatactgacatggtggagttccaggctgggtccgaaggacagctcctgccgcaacactacctcaatgacctagactctgccctcatcccagtaatccatgggggtaccagcaatagctctctacccttggagatcgaacttgtgttttttattatcgagcatctgttctag

SEQ ID NO: 56055 - DNA, 4620 bp, Artificial Sequence
  Description of Artificial Sequence: Synthetic coding sequence
atggacagttattttaaagccgctgtgtccgatcttgacaagctgctggatgatttcgaacagaacccagatgaacaggactatctacaggacgtgcagaacgcctatgactccaatcactgcagcgtcagtagcgaactggctagcagtcagcgtactagtctactgccgaaggatcaagagtgtgtgaactcttgcgcatcatcagagacctcatatggtaccaatgagtccagcctgaacgagaagaccctcaaaggtctgaccagcattcagaacgaaaagaacgtaactggccttgatctgctgagcagcgtggatggtggcacctccgacgaaattcagcctttgtacatgggcagatgttcaaaaccgatttgtgacttaatatccgacatgggaaacttagtacatgccaccaatagtgaagaggacataaagaagctcctgcccgatgactttaaatccaacgcagactccctgatcggcttggatctatcttcagtgtcagacaccccatgtgtcagctctaccgaccacgattccgacacagtgagagaacagcagaatgacatttcctctgaactgcagaatagagagatcggcggaattaaagagttgggtatcaaggtcgatacaaccctgtccgatagctacaactacagtggcacggaaaacctgaaagacaagaagatcttcaaccaattagagtctattgtagatttcaatatgtcttctgctctgacccgccagagttctaagatgtttcacgctaaagataagctgcagcacaagtcccagccatgcggcctcttgaaggacgtcggcctggttaaggaagaggtggacgttgcagtgattacagctgcagaatgtctgaaggaggagggaaaaacctcagccctgacttgctcgctgcccaaaaacgaagacctgtgtttaaacgactctaattcacgggatgagaacttcaagctgcccgacttttcgttccaggaagacaaaaccgtcatcaaacaaagcgcacaggaagactccaaaagcctggacctcaaagataacgatgttattcaagatagctcctccgctcttcacgtttcctccaaagacgtgccttctagcctgagttgcttgccagcctctgggtctatgtgcggatcactgatagaaagtaaggccagaggagatttcctccctcagcacgagcacaaagataatatccaagatgcggtgacaattcatgaggagatacagaatagtgtcgttctgggcggagagccattcaaagaaaacgatctcctgaagcaggagaagtgcaaatccatcctgttgcagtctctaatcgaaggcatggaggatagaaagattgacccggatcagactgtcattagggctgagtcactggacggaggagacacttcctcaactgtagtggagagccaggaggggctctccggtactcacgtgcccgaatcaagtgactgttgtgagggctttatcaatactttctcttctaatgacatggatggacaagatcttgactactttaacattgacgagggagcaaagtctggtcctttaattagcgatgctgaactcgacgctttcttaaccgaacagtacctacagactacaaatatcaaaagtttcgaggagaatgtgaacgactctaaatcacagatgaatcagatagatatgaaagggctggacgacggtaacataaacaatatctacttcaatgcggaggcaggggcaattggcgagtcccacggcatcaatattatctgtgagatcgtggataagcagaatactattgagaacggtttgtctctaggggagaaaagcaccatacccgtgcaacagggtttacctacgtcaaagagcgaaatcactaatcagttatctgtgagtgacattaactcacagagcgttggaggcgcaaggcccaagcaactcttcagcttacctagcagaactagatccagcaaggatttgaacaaacctgatgttccagacacaattgagtctgaacctagcactgccgataccgtcgtaccgattacatgtgctattgattcaacagccgatccgcaggtaagctttaacagcaattacatagatatcgagtcaaacagtgaaggcggaagttcattcgtcacggccaatgaagactcggtccctgagaatacctgcaaagagggactcgtccttggccagaagcagcccacgtgggtacccgacagcgaggcgcctaattgcatgaattgtcaggtgaagtttacatttacgaaaaggcgtcatcactgccgcgcttgcggaaaagtgttttgcggggtctgctgcaaccggaagtgcaaactgcagtatctggaaaaggaagctcgcgtgtgcgtggtttgctatgagactatcagcaaggcacaggcatttgagcggatgatgtcaccaactggaagcaaccttaaaagtaaccacagtgacgagtgtacgacggtgcagcccccacaggaaaaccaaacctcaagcattccctcacctgctactctccccgtgagtgctctgaaacagcccggtgttgaggggctctgttcgaaggagcagaaaagggtgtggtttgctgacggaattttacccaatggagaggttgctgacaccactaaactgtcatccgggagcaagcgttgctccgaggatttttcacccctctctccagatgtgcccatgaccgtgaacactgttgaccattcccatagtacaaccgtagaaaagcccaataacgagacgggcgatatcacacggaatgagatcatacagagccctattagtcaagttccttccgtcgaaaagctcagcatgaataccggtaacgagggattgccaacctcagggagtttcactctagacgacgacgtctttgctgagacagaagaaccctcctcccctactggggtgctcgtgaactccaatttgccgattgctagtatctccgattatcggctgctgtgcgatatcaacaaatatgtgtgtaacaagatctctctgctccccaacgatgaggactccctgcccccactgctcgtggcttcaggtgagaagggttccgtgcccgttgtcgaggagcatccctcacatgagcagattatcctccttctcgagggtgagtcttttcacccggtcactttcgtgcttaacgccaatctcctcgtgaatgttaaatttatattctactctagtgacaaatattggtacttctctacaaatgggctgcacggacttgggcaggcagagatcattattttgctattgtgtcttcccaatgaggacactattccaaaagacatcttccgtcttttcataaccatttacaaggatgcccttaaaggcaaatacatagagaatctagacaacattacgttcactgagagctttctgtcgtccaaagaccatgggggtttcctgtttattacccctacctttcaaaagctcgacgacctctcattgccctcaaatcccttcttgtgtggcattctgattcagaagctcgaaattccgtgggccaaggtcttccctatgcgactcatgctcaggttgggtgctgagtacaaggcttaccccgcacctctcacatcaattcgcggtagaaagcccctttttggggagattggtcataccataatgaacctattggtagaccttcgcaactaccagtatacactacacaacattgaccaactgttgatccatatggagatgggaaaatcttgcatcaaaatccctagaaaaaagtactctgatgtgatgaaggtcctgaattcctctaatgagcatgtcatcagtatcggagcctcattttcaaccgaggctgattcccacctggtctgtatacagaatgatgggatctacgagacacaggccaacagcgccacgggccatccccgaaaagtgaccggcgcatcctttgtcgtgtttaacggagcgctgaagacatcctccggattccttgccaagtcaagtatcgtagaggacggcctgatggtacaaataactcccgaaacgatgaatgggctgaggttggctctccgcgagcagaaggactttaagataacgtgtggaaaggtcgacgccgtggacctgcgggaatacgtggacatctgctgggtggatgccgaagagaagggcaataaaggagtcatcagttctgtggacggaatctcactacagggctttccaagtgagaaaatcaaactcgaggcagattttgaaacagatgagaaaattgtaaagtgcaccgaagtattctattttctcaaagaccaagatttgtctattctgtccacttcatatcaattcgcaaaggaaatcgccatggcgtgctccgctgctttgtgtccacacctcaaaaccctgaaatctaacggaatgaataaaattggcctgcgggtctccatcgacaccgatatggtggaattccaggcaggtagcgaggggcagctgctcccccaacattatctcaacgatctggattctgccctgatccctgtgatacatggagggaccagtaatagctccctgcccctggaaatagagctggtgttctttatcatagagcatctgttttag

SEQ ID NO: 56056 - DNA, 4620 bp, Artificial Sequence
  Description of Artificial Sequence: Synthetic coding sequence
atggacagctactttaaggctgctgtctcagacctcgacaagctgttagacgacttcgaacaaaatcctgatgaacaagattatctccaagacgtgcagaatgcctacgattcaaaccactgctctgtgagctccgaattggcaagtagtcaaagaaccagcctgctgcctaaggatcaggaatgtgtgaacagctgtgcttcaagtgagacatcgtacggtactaatgagtcatctttaaatgagaaaaccttgaaaggcctgacatccattcagaatgagaaaaatgtgacaggtttagacttgctcagctctgttgatgggggaacctccgatgaaattcagccattgtatatgggcaggtgctccaagcctatctgcgaccttatttccgacatgggtaatctcgtgcatgccacaaattcggaggaggatataaaaaagctgctccctgacgacttcaaatccaacgccgattcgctgattggactcgatctcagtagcgtttctgataccccctgtgtttcttctaccgaccacgactccgacaccgttagagagcaacagaatgatatctccagtgaattacaaaacagggagattggtggcattaaggagctagggataaaagttgatacaacgctttctgattcatacaactattctggaaccgagaaccttaaggacaaaaagatcttcaatcagctggaatccatcgtcgattttaatatgagctctgcactgacacgacagtcatccaaaatgttccacgccaaagataaactgcaacacaagtctcagccatgcgggctactgaaagacgtcggtctggtcaaggaggaagtagacgtggctgtcattacagcagccgagtgcctgaaagaagaaggcaagacaagcgcactcacgtgttctttacctaaaaacgaagatctctgcctcaacgactcgaattcacgcgatgagaatttcaaactgcccgacttcagtttccaggaagacaagacagtcatcaagcaatctgcacaagaggacagcaagagtctggatctcaaggacaatgacgttattcaggactcgagctctgcactgcacgtgtcatctaaagatgttccctcgtctctttcttgcctgccagcatccggaagtatgtgtgggagccttatagaaagcaaggccagaggcgatttcctacctcagcatgagcacaaagacaatatccaggatgccgtgaccattcacgaagagatacagaacagcgtagtattagggggagaacccttcaaagaaaatgatctcctgaaacaggagaagtgcaagtctatcctattgcaaagcctgatagaggggatggaagacaggaaaatcgatcctgaccaaacagtgattcgagcagagtccctcgacggcggtgacacaagcagtaccgtggtcgaaagtcaagagggtctcagtgggacccacgtgcccgagtcttccgactgttgcgagggatttattaatacattctcttcaaacgacatggacggtcaggaccttgactacttcaacatcgatgagggagctaagagcgggccactcattagcgatgccgagctggacgcatttctcaccgagcagtacctgcagaccacaaacatcaaatccttcgaagagaatgttaacgacagcaaaagccaaatgaaccagattgacatgaaaggcctagacgacggcaacataaataacatttactttaatgccgaggctggcgcaattggagagtctcacggaatcaatataatctgtgagatcgtggataagcagaacaccatcgaaaacggcttgagcctgggcgaaaagagcaccatccccgtgcagcaggggttgccaacatccaaaagcgagatcacaaatcagctgagcgtgagcgatattaacagccaatccgtcggcggagcgagaccaaaacagctgttcagcttgccttcaagaaccagaagcagtaaggacctcaacaaaccagacgtacccgacacaatcgagtccgagcctagcacagccgatacagtggtcccaatcacctgtgccattgactcaactgctgacccgcaggtgagttttaactctaactacatagacattgagagcaatagcgagggcggaagttcttttgtgaccgcaaatgaggacagcgtcccagaaaatacctgtaaagagggcctcgtcctcggccagaagcaacccacttgggtgcctgattccgaggcaccaaattgcatgaattgtcaggtgaagttcacattcaccaagcggaggcaccactgcagggcctgcggaaaagttttttgtggagtatgctgtaatcggaagtgcaaacttcaatacctagaaaaggaggctcgggtgtgtgtggtttgctacgaaacaatatcaaaggctcaggccttcgaacggatgatgagccccacagggtcaaacctcaaaagcaatcacagtgatgaatgtactaccgttcagcccccacaggagaatcagacgtcttcaatcccatccccagctactctcccagtgtccgcactgaagcagcccggagtagagggactgtgctccaaggagcagaaacgggtgtggttcgcagacggcatcctccctaatggcgaggtcgccgataccacaaaacttagcagcggcagcaagagatgttccgaggatttttccccattatcccctgacgttccaatgacagtcaacactgtggatcactcccactccaccacagtagagaaacctaataacgagaccggcgacattacgcgcaatgaaatcattcagagccctattagtcaggtcccatctgttgagaagttgtccatgaacaccggcaacgaaggattgccaacttccgggtcgtttactctagacgacgatgtgtttgcggaaaccgaggaacctagtagccccaccggagtcttggtgaattccaatcttcccattgcctcaattagtgattaccgcctgctttgtgatatcaacaagtatgtctgtaataaaatttcccttctgccaaacgatgaggactctctgcctccgctgctggtggcctcaggagagaaaggctctgttcccgtggtggaggagcaccctagccatgagcagataatcctgctcctggagggcgaaagttttcatcccgttactttcgtgcttaacgctaacttgttagtgaatgtgaaatttatcttctatagttccgacaaatactggtactttagcaccaacggcttgcacggtctggggcaggccgagatcatcatcctgttgctctgcctcccgaatgaggacacaattcccaaagacattttcagactctttatcacgatttacaaagacgcactgaaaggcaaatacatcgaaaatcttgacaacatcacttttaccgagtccttcttgtcctccaaagaccacgggggattcttgttcatcacgcctaccttccagaaacttgatgaccttagtctgcctagcaaccctttcctgtgtggcatcctcatccagaagctcgaaataccttgggcaaaggtgttccccatgaggctcatgcttcgtctcggcgcagagtacaaagcttaccctgcaccactgaccagtatcaggggacggaagcccctgttcggcgagattggtcataccatcatgaatctgctggtggatttgcgcaactatcaatataccctgcacaacatcgatcagctcctgattcacatggaaatgggaaaaagctgcataaagattcctcgtaagaagtacagcgacgtgatgaaggtcctgaactcaagcaatgagcacgtgatctctatcggcgcttctttctccactgaggcagacagccacttggtctgcatccagaacgacggaatatacgaaacacaggccaactctgccacagggcatccgagaaaggttaccggggcttcgtttgtggtgttcaacggggctctgaaaacaagctccggctttctcgctaaatccagtatcgtggaagatggactgatggtccagatcacacctgagacaatgaatggcctccgtttagcccttcgagaacagaaggattttaagattacctgcggaaaggtcgacgctgtcgacctgagagagtacgtcgatatttgttgggtcgacgcagaagagaaaggaaataagggtgtgatctcctcggtagatggaatatctcttcagggctttcctagcgagaaaattaagcttgaggccgacttcgagactgatgagaagattgtcaaatgtaccgaagtcttctactttctcaaggatcaagacctgagcatcctgtctacttcctaccaattcgccaaggaaatcgccatggcttgctctgctgctctgtgtccacacttaaagacgctaaagagcaacggtatgaacaagattggtctgagggtgtctattgacactgacatggtggagtttcaggccggttcagagggacaactgctgccacagcattacctgaacgatttggactcagcactcatcccagtgatccacggcggtacctcaaactctagtctgcctctggagatagaactggtttttttcataatcgagcatcttttctag

SEQ ID NO: 56057 - DNA, 2355 bp, Artificial Sequence
  Description of Artificial Sequence: Synthetic coding sequence
atggcaagtctggacgatcccggtgaggtgcgagagggtttcctatgccctttgtgcctgaaggatctgcagagcttctatcagctgcactctcattatgaggaggagcacagcggggaggatagagatgttaagggacagattaagtccttggtccagaaagccaaaaaggccaaggacaggctactgaaaagagagggagatgaccgcgctgaaagtggaactcagggttacgagtctttcagctacgggggagttgatccttacatgtgggagcctcaggaattaggcgcagtgcgcagccacctgtcagacttcaaaaagcacagggccgcaagaattgaccactacgtagtggaggttaacaaactcatcatcagactagagaaacttactgcctttgaccgtacaaatactgaatccgccaagataagagccatagagaaaagtgtggtaccgtgggtcaacgaccaagacgtcccattttgccccgactgcgggaataagttttcaatcagaaaccgacgacaccattgtaggctctgcggcagtatcatgtgtaagaagtgcatggagctgatttctctgccattggccaataagttaacatcggcctctaaagaaagcctttcaacccacacatcaccctcacagagtccgaactctgtgcacggaagcaggcggggatctatctcgtcaatgtcctctgtatcctctgtactggacgaaaaagacgatgatagaattcgctgctgtacccattgcaaagacaccctgctcaagagggaacagcagattgatgagaaggagcacacgcccgacattgtaaaactgtatgagaagctgaggctttgcatggaaaaagtagatcagaaagcacctgagtacatacgcatggcagcctcattgaatgctggcgagaccacatactccctggagcacgcatcggatctgcgagttgaagttcagaaggtttacgagctgatcgacgccctctctaagaagatcctgacactcggactcaaccaggaccctccccctcacccctctaacctgcgactgcagcgcatgatcagatattccgctactctttttgtgcaagagaagctgttgggtctgatgagccttccaacaaaagagcagttcgaagagctgaagaagaaacgcaaggaagagatggagaggaaacgggctgtcgaacggcaggcggctttggaatctcagcggaggcttgaagaaagacaatctggactagctagccgcgcagccaacggcgaggtggcaagcctgcgaagaggaccggcaccactgaggaaggctgaggggtggctgcctctgagtggtggacagggccaaagcgaagatagcgacccccttttgcagcagatccacaacatcacctctttcattcgccaagctaaggcggcagggagaatggatgaggtcagaaccctgcaggagaacctccgacagttgcaggatgaatatgaccagcagcagacagaaaaagccatagagctgagtaggagacaggccgaggaggaggacctacaaagagaacagctccagatgttgagagaacgcgagctggaaagggaaagagagcagttcagggtggccagccttcacactcgaaccaggagccttgattttagggaaataggcccatttcagctcgaaccttctcgcgaacctcgtacacacctcgcctatgcattggacctgggtagcagcccagtgcccagtagtaccgccccaaagacgccctcactatcatccacccagcccacaagggtgtggtctggtcccccagctgtgggtcaggagcgcctgccccaatccagtatgccccaacagcacgaaggcccaagtctcaatccatttgacgaagaggacctgtcctcccccatggaggaagctacaaccggaccccctgccgctggtgtgtccctcgatccgtccgcacgtatcctcaaagagtacaatcctttcgaggaagaagacgaggaggaagaggcagttgccggtaaccctttcatccagcctgattccccggcacctaaccctttttctgaggaagatgaacaccctcagcaacggctgtcgtcccctctggtccctggcaatccctttgaggagcccacctgcatcaacccctttgagatggatagcgacagcggcccagaggcagaggagccgatcgaggaggagttgttgctccagcagatcgacaacattaaggcctacatcttcgatgcaaagcagtgcggcaggttggacgaagttgaggtgttgactgaaaatttgcgggagctgaagcacaccctcgccaagcaaaaggggggaacagactag

SEQ ID NO: 56058 - DNA, 438 bp, Artificial Sequence
  Description of Artificial Sequence: Synthetic coding sequence
atggccgcatccctgaacgcaggcgaaactacttatagcctggagcacgctagtgacctcagggtcgaggtccagaaggtctatgagctgattgatgctctgtccaaaaaaatcctcaccctcgggctcaatcaggaccctcctccgcatcctagcaatctgcggctgcagcgcatgatcaggtactccgccaccctattcgtccaggaaaagctcctggggctcatgtctttgcctacaaaagagcagttcgaggagcttaagaagaagcggaaggaagagatggagaggaagagagccgtcgaaagacaggctgcccttgagtcacagaggcggctggaggagcggcagagagcgagccaccccccttgcttatgctttgggtcaaggctgtttccttccagcaagcagcacagttcacaagacccttttacatag

SEQ ID NO: 56059 - DNA, 627 bp, Artificial Sequence
  Description of Artificial Sequence: Synthetic coding sequence
atggcgtccctcgatgatcccggtgaggtgagggagggtttcctgtgtccattatgcctgaaagatcttcagtccttttaccagcttcatagtcactacgaggaggagcactcaggcgaagatcgggatgtgaaaggccaaataaagagtcttgtgcaaaaggccaagaaagcgaaggatcgattgcttaagcgagagggagatgatcgggctgaatccggtacgcagggatatgaatcattcagctatgggggtgtcgacccttacatgtgggaaccccaggagttaggggctgtgcggagccaccttagcgattttaaaaagcacagagctgccaggatagaccactatgtcgtcgaggtgaataagttgattatccgtctggaaaaactgaccgcatttgaccggactaataccgagagtgccaaaattagggcaattgagaaaagcgtcgtcccatgggtgaacgatcaagacgtgccattttgtccggactgtggcaataagttcagcattcgaaatagacgacaccactgtcgcttgtgtggctccattatgtgcaaaaagtgcatggaacttataagccttccacttgctaagataacgacactgcatggcgagagctag

SEQ ID NO: 56060 - DNA, 2355 bp, Artificial Sequence
  Description of Artificial Sequence: Synthetic coding sequence
atggcctcattagacgatcccggagaagtgcgggaaggcttcctgtgcccactttgccttaaggatctacagagcttctaccagctgcacagccactatgaagaagaacattcaggtgaagacagggatgtcaaaggccagattaaaagcctcgtgcagaaggcgaaaaaagccaaagatcggctgctgaagcgcgaaggcgacgatcgtgccgagtcaggtacccagggttacgaatcgttctcctatggaggggtagacccttatatgtgggaaccccaggaattaggagcggtacgcagccacctctctgattttaagaagcatcgcgcagctaggattgatcactacgtcgttgaggttaataaactgattatcaggcttgagaaattaacagcattcgatagaaccaacacagaaagcgccaagattcgggctattgagaagtctgttgtcccctgggtgaacgaccaggatgtgcccttctgtccagattgtggaaacaagttcagcatccggaaccgaagacaccactgtcggctgtgtggaagcatcatgtgcaagaaatgtatggagctgatcagcttacctctggccaataagctcactagcgcctccaaggagtcgttgtctactcatacatctccttctcagagtcctaattctgtgcacggtagtcgtagaggttcaatttcttccatgtcctccgtcagcagcgtgttggacgaaaaagatgacgataggatccgctgttgcactcattgcaaggacacgcttcttaaacgcgagcaacagatagacgaaaaagaacacacaccagacattgtgaagctgtatgagaaactgcggctttgcatggagaaggttgaccagaaggcccctgagtacatccgtatggcagctagtttaaatgctggcgaaacaacgtactccctcgaacacgcatccgacctgcgcgtggaagtccagaaagtatatgaactgattgacgccctctctaaaaagatcttgacccttggtttgaaccaggatccccctccacatccctcaaaccttcgactgcaacgtatgatccgatatagcgccaccttgtttgtccaggaaaagctgctcgggctaatgtctttacccaccaaagaacagtttgaggagttgaaaaaaaagagaaaggaggaaatggaacggaagagagccgttgagcgccaggccgcacttgaatctcagaggcgcttagaggagaggcagagcggcctggcttccagagccgctaacggtgaggtcgcttcactaagaagaggcccagcgcctctgcgcaaggcggagggctggctcccactgtcaggaggtcaaggccaaagtgaggacagcgatccgcttctgcagcagatccacaatattacatcattcatacgccaagccaaagccgcaggtcgcatggacgaagtgcgcacactgcaggagaacctgaggcagctgcaggatgaatacgaccagcagcagacagagaaagctattgaattgagccgcagacaggccgaggaggaggatttgcagcgagagcagctacagatgctgcgcgagcgcgagctagaacgggaacgtgagcagttccgggtggcaagtcttcatactaggacaagatccttagattttagggagataggcccatttcaactggagccctctcgggaacccagaacccacctggcatacgccctggacctggggtccagccccgtgccatcttcgaccgcgcctaaaacgccaagccttagcagcacgcagcccaccagggtttggagcggcccaccagccgtggggcaggagcgcttaccacagagctccatgccccaacaacatgaagggccaagcctcaatcctttcgacgaggaggacctttcatcaccaatggaggaggctaccacaggacctcccgctgccggagtcagcttagaccctagcgccagaattctcaaagagtacaacccttttgaagaagaggacgaggaagaggaagctgttgctggcaatccattcatacagcctgatagccccgcacctaatcccttctctgaagaagacgaacacccccagcagcggcttagcagcccccttgtgccaggcaatccattcgaggagccaacgtgtatcaatcctttcgagatggactcagactccgggcctgaagccgaggagccaattgaagaagaactgctgctccagcagatcgacaacatcaaggcctatattttcgacgccaaacaatgtgggaggctagatgaggtagaagtcttgacagagaacttaagggaactgaaacatacactggcgaagcagaaaggagggacagattag

SEQ ID NO: 56061 - DNA, 126 bp, Artificial Sequence
  Description of Artificial Sequence: Synthetic coding sequence
atggcttcactagacgatccaggcgaggttagggagggatttctctgccctctgtgcctcaaggatcttcagagtttttaccaattgcacagccactacgaagaagaacatagtggggaggattag

SEQ ID NO: 56062 - DNA, 4278 bp, Artificial Sequence
  Description of Artificial Sequence: Synthetic coding sequence
atggaaaactattttcaagccgaggcctataacctggacaaggtgcttgacgagttcgagcaaaacgaagacgagactgtgtcctcaaccctgcttgatacaaaatggaataagatcctggacccgccaagtcatcgcctctccttcaacccaacactggcctctgtgaacgagtcagctgtttctaatgaatcccagccgcagttgaaggtctttagtctcgcacacagtgccccactgaccaccgaggaggaagaccactgcgccaatgggcaggactgtaacctcaatccagaaattgccaccatgtggatagacgagaacgcggtcgcagaagaccagctgattaagcggaattatagctgggatgaccaatgttcagccgtggaagtcggcgagaagaagtgcgggaacctggcgtgtctgccggacgagaaaaacgttctcgtggtagccgtgatgcacaattgtgataaacgaacattgcagaacgatcttcaggactgcaacaactataactctcagagtctcatggacgcgttctcctgctcgttagacaacgagaatagacagactgatcagtttagcttttccattaacgagagtactgagaaggacatgaattccgagaagcaaatggacccccttaaccgtcccaaaacagagggcaggtcagtgaatcacttgtgccctacatcttctgatagtctcgctagcgtgtgcagcccttcacagctgaaggatgatggctctataggcagggatcccagcatgtccgctattaccagcctgacagtggactctgtgatctcatcccagggcacagacggatgccccgctgtgaagaagcaggaaaactacatccccgatgaggacctgactggcaagatttctagtcctcgaaccgacctgggttcgcctaacagctttagccacatgagcgaggggatcctcatgaaaaaagaacccgcagaagaatctacaaccgaggaaagcctccggtcaggtcttcccctgctcctaaagccggatatgcccaacgggagtggccgaaacaacgattgcgagaggtgttcggactgtctggtgccaaacgaagtgcgggctgatgaaaatgagggatatgagcacgaggaaacgctaggcaccactgaattcttgaacatgaccgaacactttagcgaatctcaggatatgaccaattggaagttgactaaattgaacgaaatgaatgacagccaggtcaacgaggagaaagaaaagtttctgcagatttctcagccagaggacacaaatggcgattccggagggcagtgcgtaggcctggccgacgccggactcgatttgaaaggaacatgcatttccgaatctgaggaatgcgacttcagtacagtaatagatactccagccgctaattatttgtcaaacgggtgcgatagttacggtatgcaggatccgggagtgtctttcgtaccgaaaacccttccttctaaagaggactctgtcaccgaagagaaggagattgaggagtcaaaaagcgaatgttattcgaatatatacgagcagaggggcaacgaggccaccgaagggtcagggcttctattaaattctacgggcgatttaatgaagaagaattatctgcacaacttttgctcacaggtcccgtctgtgctaggccaaagctctcctaaggtggtggcctctctgccgtccatcagcgtgcctttcggaggggcacgccctaagcaaccttcaaatctcaagctgcagatcccgaagccattgtctgatcacctgcagaatgacttcccggcaaatagcggcaataatactaaaaataaaaacgacattcttggtaaggctaaactgggtgagaattcagcaactaacgtgtgttctcctagtttaggtaacattagcaatgtggacaccaatggagagcacttagaatcctacgaagctgaaatctccacccggccttgcttggctcttgccccagactccccggataacgacctccgagctggtcagtttggaatttccgccaggaaacccttcactactcttggtgaggtcgctcccgtttgggttcccgactcccaagcccctaattgtatgaagtgcgaggcaagattcaccttcacaaagcgcagacaccattgtagagcctgcgggaaagtcttctgcgcttcctgctgttcgctcaagtgcaagctcttgtacatggatcggaaggaggcacgggtgtgcgtaatttgccacagtgtgctgatgaatgcccaggcatgggagaacatgatgagtgcctctagccaatcccccaacccaaataaccccgctgagtactgtagcactatccctcccctgcagcaggctcaggccagtggcgctctgagctcaccaccgcctactgtgatggtccctgtcggtgttcttaagcacccgggagctgaagttgcccagcctagagaacagaggagggtttggttcgccgacggaattctgccaaatggtgaggtggcagatgcagctaaactgaccatgaatggcaccagcagtgccggaacactcgctgtttcccatgatccagtcaaacccgtaaccacctccccgttaccagcagaaacagacatctgtctgtttagtggctctataactcaggtcgggagtccagtgggtagtgccatgaacttgatcccggaggacggtcttcctccaattcttatcagtactggagtcaaaggagattacgccgtcgaagaaaaaccatctcagatcagcgtgatgcagcaactcgaagacggcggacccgaccccttggtttttgttctgaatgcaaatttactcagcatggtgaagattgtcaattacgtgaatcggaagtgttggtgcttcactaccaagggaatgcacgcagtggggcagtccgagattgtgatactgctccagtgccttccagacgaaaagtgcttacccaaagatatttttaatcactttgtccagctctatagagacgctttggctggcaacgtcgtgtcaaatctaggccattccttttttagccagtcctttctcggaagtaaagagcatggaggttttttatacgtgaccagtacctatcagtctttacaagacctggtcttgcccacccccccttacctctttggcatcttgattcagaaatgggagacaccttgggccaaagtttttccaataaggttgatgctgcggttaggcgctgagtatcggctgtacccttgcccactgttctctgtccgatttcgaaaaccgctgtttggggagaccggacacaccatcatgaacctgctggcggatttcaggaattaccaatatactctgcccgtcgtgcaaggtctggtggtagacatggaggtgcgcaagacatctataaaaatcccatctaaccgctataatgagatgatgaaggcaatgaataaatccaatgaacacgtgctcgcgggtggggcatgtttcaacgagaaggccgacagtcatctggtttgtgtgcagaacgatgatggaaattaccagacacaggccatctctatacataatcaacccagaaaagtgacgggcgcatcattcttcgttttctccggcgctctgaagagtagcagcgggtatctggcaaaatcttctatagtggaggacggagttatggtgcagatcactgccgagaatatggactccctccgccaggcactgagagaaatgaaggacttcaccattacctgtggcaaggctgacgccgaggagccccaggagcatatccacatccagtgggttgacgatgataaaaacgtctccaagggcgtagtgtctccaattgatggaaaaagcatggaaaccatcacaaacgtcaagatctttcacgggagcgagtataaggccaatggcaaggtgatccgatggaccgaggttttcttcctggagaacgatgaccagcataattgtctgtccgatcccgcagaccattctcggcttaccgagcacgtggccaaggccttttgcctggcattgtgcccacatctaaagttgttaaaggaagatggcatgactaagctcggactgcgcgtcacacttgattcggaccaggtaggctaccaagccggaagcaacgggcaaccattgccgagtcagtacatgaatgacttggactccgccctggtgcctgtaattcacgggggagcatgtcagctgagcgaggggccagtggtgatggaactgatcttctacattctggagaacatcgtgtag

SEQ ID NO: 56063 - DNA, 4101 bp, Artificial Sequence
  Description of Artificial Sequence: Synthetic coding sequence
atggaaaactacttccaggctgaggcatataacctggacaaagtgctggatgaattcgaacagaacgaggacgaaacagtaagctctaccctgttggatactaaatggaacaagattctggaccccccatcacaccggctgtcatttaacccaactctggcatctgtgaacgaaagtgcagtgagtaatgagtctcaaccacaactcaaagtcttcagtttggctcactctgcccctcttactaccgaggaggaggatcactgtgcaaacggccaggattgcaacctgaatcccgaaatagcaaccatgtggatcgacgaaaacgccgtcgcagaagaccagctaattaagagaaattatagttgggacgaccaatgctccgccgttgaagttggtgagaagaagtgcggcaatttagcttgcctgcctgatgagaaaaacgtgttggtggtagctgtgatgcataactgtgacaagagaacactccagaacgacttgcaagattgtaataattataactcccagagcctcatggacgccttttcgtgtagtctggataacgagaatcggcagaccgaccagttctccttctccataaatgagtccaccgagaaagatatgaattccgaaaagcaaatggatcccttaaatcgacccaaaactgaaggtagatccgtgaaccatctgtgtcccaccagctcggactctctggcatctgtttgtagcccgtctcagctcaaggatgacggatctatcggcagggatccctcgatgtccgcaatcacatcactgaccgttgactcggtcataagctcacaaggcaccgacggctgccctgccgtgaaaaaacaggaaaattacatcccagatgaagatcttacaggcaagatctcaagccctagaacagatctcgggagtccaaattcattcagccatatgagcgaggggattctcatgaagaaagaacctgcagaagaaagcaccaccgaagagtcactacgctctggcctacccctcctactgaaacctgatatgccaaatgggagcgggaggaacaatgactgcgagcggtgttcggattgcctcgtacccaatgaagtaagggctgacgaaaatgaagggtacgagcacgaagaaaccctgggcactacagagtttctcaacatgaccgaacacttttcggagtcacaggatatgacgaattggaagcttacgaaactcaacgaaatgaatgattcccaggtgaacgaagagaaggaaaagtttctgcagatctcacagcctgaggatacaaacggcgattccggaggccagtgcgtgggcctcgccgatgcgggtctggacttgaaaggaacatgtatctccgagagtgaggagtgcgacttctctacggtaatcgatactcccgctgccaattacctctctaacggatgtgatagttacggtatgcaagacccaggcgtgagcttcgtccctaagacactgccaagcaaggaggactcagttacggaagagaaagagattgaagaatcgaagtccgagtgctactccaatatatacgaacaaaggggtaacgaggctacagaaggttctggactgctgttgaattcaaccggagatttaatgaagaaaaactacctgcacaacttttgttcccaagtgccttccgtcttgggccagagttccccaaaggtcgtggctagtctaccttcaatctcagtgcccttcggaggggcaaggcctaaacaacccagcaatctgaagctccagatccccaaacctctttcagaccatctccagaatgattttcccgctaactctggaaataacacaaagaacaagaacgacattctgggcaaagccaaacttggcgagaacagtgctactaacgtgtgctcgccaagtctgggaaacattagtaacgtggacactaatggagaacacctggagtcttatgaggctgagattagcacccgcccttgtctggccctggcgcctgattccccagataacgatttgagggcaggacagtttggaatttccgcacggaagccttttaccacactcggcgaggtggcgccagtgtgggttcccgatagccaagcccctaattgcatgaaatgtgaagccagattcacattcaccaagcggaggcatcattgcagggcttgcggaaaagtgttctgtgcgtcctgttgttctttaaagtgcaaactgctgtatatggacagaaaggaagcacgggtttgcgtgatctgccatagtgtgctaatgaatgtggcccaaccgagggagcagcgcagggtttggttcgcagatgggatcctgccaaacggggaggtcgctgatgcggctaagctgacaatgaatgggacctccagtgctggcactctcgctgtgtcacatgaccccgtgaagccggtaaccacctctcccctaccagccgagactgatatttgtttattttcaggaagcattacgcaggtggggtctcctgtggggagcgcgatgaatcttatacctgaggacggactcccacccatcttgatctccactggagtgaagggagattatgcagtcgaagagaaaccctctcagattagcgtaatgcagcagctagaggacgggggaccggaccccctggttttcgtgcttaacgcaaacctcttgtctatggtgaagatcgtcaattacgtcaacaggaagtgctggtgtttcaccaccaaaggcatgcacgctgtgggtcagagcgagatcgtgattctcctgcagtgtctgccagatgagaaatgcctacccaaagatatcttcaatcacttcgtgcagctatacagggacgccctggctggtaatgttgtttccaaccttggacattcttttttttcgcagtctttcctcggctccaaagaacacggaggctttctgtatgtcaccagtacataccagagccttcaggacctcgtcttgccgacacctccatacctgttcggcattctgatccagaagtgggaaaccccatgggcgaaagtgttccctatccgcttgatgctgcggctgggcgctgaatatcgattgtacccctgccctcttttctctgtacgtttccgcaagccattgttcggcgagactggacataccattatgaacctactcgcagatttcaggaattaccaatacacgctacctgtggtccaaggactggtggttgacatggaagtgaggaaaaccagtatcaaaatcccaagtaatcgctataacgaaatgatgaaggcaatgaataagtcaaacgagcatgttctcgcagggggagcatgttttaatgagaaggcagactctcacttagtgtgcgtgcagaatgatgatggcaactaccagacacaggcaatctccatccacaatcagcctcgcaaagtgacaggagcctccttttttgttttcagcggagccctgaagtctagtagcgggtatctcgcaaaatcctctatcgtagaagatggtgtgatggttcaaatcacagcagagaatatggattctttgcggcaggctttgcgggagatgaaagacttcacaatcacttgcgggaaggcggatgcagaagaacctcaggagcacattcatatccagtgggtcgacgacgacaaaaatgtctccaagggtgtagtgtcaccaatcgatgggaagtccatggaaactatcactaacgtgaaaatattccatggttctgaatacaaggcgaacggcaaagttatacggtggaccgaagtcttttttctggaaaatgatgatcagcacaattgcctgtccgaccctgcagatcatagtcgccttaccgagcacgtcgctaaagcattttgcttggccctgtgcccccaccttaagcttctaaaggaagacggtatgacaaaacttggattaagagtgacccttgatagcgaccaggtgggctatcaggcaggaagcaacgggcagcccctcccctcacagtatatgaacgatctagactcagcgctggtcccagtgatccacgggggagcctgtcagctctccgaaggcccagtggtgatggagttaattttctacatcttggagaatattgtctag

SEQ ID NO: 56064 - DNA, 2289 bp, Artificial Sequence
  Description of Artificial Sequence: Synthetic coding sequence
atggaaaattactttcaggctgaagcctacaacctcgacaaagtcctcgacgaattcgaacagaacgaagatgagactgtctcctctacgctcctcgacactaagtggaataagattctggatccacccagccatagattatcgttcaaccctactctggcatctgtgaacgaaagtgccgtgagtaatgagtcacagccccagcttaaagtcttctcgctggcccacagcgctcctctgacaacggaggaagaagatcattgcgccaacggacaagactgtaacctgaaccccgaaatcgcaaccatgtggatcgatgagaatgcagtggccgaggaccagcttatcaagcgtaactattcatgggatgatcagtgcagtgctgtcgaggtcggagagaagaagtgcggcaatctggcatgcttgcctgacgagaagaatgtgctcgtggtcgcggttatgcataattgcgacaagcgaacgcttcagaacgatcttcaggattgcaataactataattctcagagcctgatggatgccttctcctgttctctagacaacgagaacaggcagaccgatcagtttagttttagcatcaacgaatctactgaaaaagacatgaactctgagaagcagatggaccctctgaataggcctaaaaccgaggggaggtccgttaatcatctatgccctacctcctcggacagtttagccagcgtgtgcagcccttctcagctgaaggatgatggaagcattgggagagacccttccatgtctgcgatcacatccttaacagtggattccgtgatttcttcccagggaaccgacggctgccctgctgtgaagaagcaagagaactatataccagacgaagacttgaccggcaaaataagctctcctaggacggacctaggttcaccgaattccttcagccatatgtcagagggtatcctgatgaaaaaagagcccgcagaagagtcgaccacggaggagagcctgcgcagcggactgcctctgctcctaaagccagatatgcctaacgggagcggtaggaataatgattgcgaaaggtgctctgattgcctagtaccaaatgaagtgcgggctgatgaaaatgaaggttacgagcacgaagagacacttggaaccacagagttcttgaatatgactgagcatttttccgagtctcaagacatgacgaattggaaattaacgaaactcaatgaaatgaacgactcccaggtgaacgaagaaaaggagaaattcctccagatttcccaaccagaggacacaaacggtgacagcggcggtcagtgcgtcggcctagccgatgccggattggacctgaaggggacatgcatctccgaatcagaagagtgtgatttctcaacggtgatagacacccctgctgcaaattacctttccaacgggtgtgattcctacgggatgcaggatcctggcgtttcttttgtccctaaaacactgccttccaaagaagattcggtgaccgaggagaaagaaatcgaagagagtaaatcggaatgttattctaatatatacgagcaaagaggaaatgaggccaccgaaggctccgggctgctgctgaactccacaggagatctgatgaaaaaaaactatctccacaacttctgcagccaggtgcccagtgtgcttggtcagagtagccccaaggtagtggcctcgcttccgtccatctctgtgccttttgggggagccagaccaaaacagccctctaaccttaagctacaaattcctaagcctctgagtgatcatctccagaatgatttcccggctaacagtggtaataatactaagaacaaaaacgacatcctgggcaaagccaagttaggagagaactccgcgactaatgtgtgctctcccagtcttggaaatatctcaaacgtcgacaccaacggcgaacacttagaatcctacgaggcagaaatctccacacggccatgcctggccttagccccagattcacctgacaatgacctgcgtgccggacagttcggaatctcagcccgtaaaccgttcaccacgctgggggaagttgctcctgtgtgggtccctgatagccaggcccctaactgcatgaaatgtgaggctcgcttcaccttcaccaaaaggaggcatcactgcagggcttgcggaaaagtgttttgtgcttcttgttgttctctcaaatgtaaattgctgtatatggatagaaaagaggcccgtgtttgcgtcatttgccactccgtactgatgaatggaaagtattag

SEQ ID NO: 56065 - DNA, 4278 bp, Artificial Sequence
  Description of Artificial Sequence: Synthetic coding sequence
atggaaaattactttcaggcggaagcatacaacctggataaagtcctggatgaattcgaacaaaacgaggatgaaactgttagctctacactacttgacacgaaatggaacaagatcctcgaccctccatctcacagattatcattcaatccgacactggcttcggtcaatgagtcggctgtgagtaatgagagccagccccaactgaaggtattctcactggcccacagcgccccactcacaacagaggaggaagaccactgcgccaacggtcaggactgcaacctgaatcccgaaattgcaaccatgtggattgatgaaaatgcagttgcagaggatcagcttattaaaaggaattacagttgggacgatcaatgtagtgccgtggaggtgggcgagaagaagtgcggcaatctagcctgtctgcctgatgagaaaaatgtgctggtcgttgctgtgatgcacaactgcgataagagaacactgcagaacgacctgcaggactgtaacaactataactctcagtctctcatggacgcgttctcatgctcactggacaacgagaatagacagactgaccaattttcattctctatcaatgagtcgactgagaaggacatgaacagtgaaaagcagatggatccgctgaaccgacccaaaactgagggacgctccgtgaaccacctctgccccacctcatctgactcccttgcctccgtctgcagtcccagccagctcaaggacgatggctctatcgggcgtgacccatcgatgagtgcaattacctctctgaccgtggactcggttatttcctctcagggcaccgatggatgtccggcagtgaagaagcaggagaactacatcccagacgaagacttaactggaaagataagctcccccaggacggatttaggttcccccaactctttctctcatatgtccgagggcatactgatgaagaaggaaccagctgaagaatctacgacagaagaatctctccggtcaggactgccgttgctcctcaaaccagacatgccaaacggttctgggaggaataacgattgtgagaggtgtagtgactgtctcgtgccaaatgaggttagggccgacgagaacgagggttatgaacatgaagagacacttggcacaaccgaattcttgaacatgaccgaacatttttccgaatcccaagatatgaccaactggaaactcacaaagctgaacgaaatgaacgatagtcaggtgaacgaagagaaggagaagttcctgcagatatctcaacccgaagacacaaacggcgatagcggaggtcagtgcgtgggccttgctgatgccggtcttgatttgaaaggaacctgcatttctgaaagtgaggagtgcgacttttctacagtgatagacactcctgctgccaactatctcagcaatggctgtgactcatacggcatgcaggacccaggggtttcattcgtgccgaaaactctgccgtccaaggaagactctgtcactgaggaaaaggagatcgaggagagtaaatcggagtgctactctaatatatatgaacagcgtggtaatgaagcgacagagggctctgggctactcctgaattcaaccggggacttgatgaaaaaaaactatcttcataatttctgctctcaagttccatcagtccttgggcaatcttcacccaaggtcgttgcatctctcccatcgatcagtgttccctttggcggtgccagacctaagcagccctccaatctaaaactgcagattcctaaaccgctcagtgaccacctgcagaatgattttcctgctaacagcggcaacaataccaaaaataagaatgacatccttgggaaggctaagttaggcgagaatagcgccaccaatgtctgcagtccctcactcgggaatatctccaatgtggacactaacggcgagcatctggagtcttacgaggccgagatttcaacccgaccttgcctggccctcgccccagatagtcctgacaatgaccttcgtgccggacaattcggtatcagcgcgaggaagccttttaccacgttgggagaggtcgcccctgtgtgggtccctgattcccaggcaccaaactgcatgaagtgtgaagcgaggttcacctttacaaagaggcgtcaccactgtagggcttgcggaaaggtcttttgtgcatcatgttgttctctcaaatgcaaacttctctacatggatcgtaaagaagctcgtgtttgcgtaatctgtcacagcgtgcttatgaatgcgcaggcttgggaaaacatgatgtcggcaagctcccaatcgcctaaccctaacaatcctgcggagtattgctctacgatccctccattgcagcaggcacaggcttccggagctctcagctccccacctccgactgtcatggtaccagtgggggttcttaaacacccaggcgcagaggtggcccaacctagagagcagcgccgagtgtggttcgctgacgggatcttgcccaacggagaagtggctgacgccgcaaagctcaccatgaacggaacgagcagcgccggaactctcgccgtctcgcacgacccagtaaaacccgttacaacctctcctcttcccgcagagacagacatttgtctgttctccggctctatcactcaggtgggaagtcccgtcggcagcgccatgaatcttattcccgaggacgggctacctccaatccttattagtaccggagtgaaaggagattacgccgtggaggagaaaccgagtcaaattagtgttatgcagcagctggaggacggcggacccgatccgttagtatttgttttaaatgctaatcttctctctatggtcaagatcgtgaactatgtcaaccgcaagtgttggtgctttaccacgaaaggcatgcacgcagtcggacagagcgaaattgtcatcctgctgcagtgcttgccagacgagaaatgtttgcctaaggacatcttcaaccacttcgtgcagttatatagagatgcacttgctggcaatgttgtaagtaatctcgggcatagtttcttctcgcaaagcttcctgggtagtaaggaacacggcggatttctttatgtgacatcgacctatcaatcacttcaggatctcgttctgccgactccgccatatctgtttggcatcctcattcagaaatgggagactccgtgggctaaggtctttccaatccgcctcatgctgaggttgggggctgagtaccgactgtacccctgccccctcttctcggtccggttccgcaaacccctgttcggagagactggtcataccatcatgaatcttctcgctgattttcgtaactaccagtacactttacccgtggtccaaggcctcgttgtggatatggaagtgagaaagaccagcataaagattccaagtaacagatataatgagatgatgaaggctatgaataaatctaatgagcatgtgctagctggaggagcatgcttcaatgagaaggctgactcccatttggtttgtgtgcagaatgacgatggaaattaccaaactcaggccatcagcatccataaccaaccaaggaaggttactggcgcttcgttcttcgtcttctctggcgcactgaaatcctccagcggataccttgctaagtctagcattgtcgaagacggtgtgatggtacagatcactgctgagaacatggactctttgcggcaggccctcagagagatgaaggacttcacgatcacttgcggcaaggcagatgccgaggaaccacaggagcacatccacatccagtgggttgacgacgacaagaatgtgtcaaagggtgtagtgagtcctatcgatggaaagtccatggagaccatcactaacgtcaaaatattccatggatccgagtataaggccaacggcaaagtcattagatggacggaagtgttctttctggagaatgatgaccagcataattgtctgtcagaccccgcagatcactctcggttaaccgaacatgtggctaaagcgttctgtttggccctgtgtccacatctgaaattattaaaagaagacggtatgacgaaattgggtctccgcgtcacattagatagtgaccaggtcgggtatcaggcaggaagtaatggccagccactgccttctcagtatatgaacgatttagatagcgctttggtgccagttatccacgggggtgcctgccagctgagtgaaggtcccgtggtcatggaattaatcttctatatcctagagaacatcgtgtag

SEQ ID NO: 56066 - DNA, 2514 bp, Artificial Sequence
  Description of Artificial Sequence: Synthetic coding sequence
atggccagcaagagaaaatccaccacgccctgcatggtcaggaccagccaagtggttgaacaggatgtcccagaagaagtggatcgtgcaaaagaaaaaggcatcggcacaccacagccagacgtagctaaagattcttgggcggctgaattggagaattccagcaaagagaacgaagtgatcgaagtcaaaagtatgggggagtcacagagcaagaaacttcagggtggctacgaatgcaagtattgtccttactctacacagaatctaaacgaattcaccgaacatgttgacatgcagcacccaaatgtgattctgaaccctctgtatgtctgcgccgaatgcaattttaccaccaagaaatatgatagcctaagcgatcacaactcaaaatttcaccccggtgaagccaacttcaagcttaagctcatcaaaaggaataatcaaacagtgctggagcagagtattgaaaccactaatcacgtggtgtcgataactacgagcggtcccggtactggcgactcggattcagggatctcagtatctaagactccgatcatgaaaccaggaaagcctaaagcagacgccaaaaaagtgcccaaaaagccggaggagattactcctgagaaccatgttgaaggaaccgcccgtctcgtcacggacaccgcagagatcctttcaaggttggggggtgtggagttactccaagatactttaggtcacgtcatgccgtcagtacaactacctccaaatatcaatctggtccccaaagtaccagtacccctgaataccactaaatacaacagcgctttagataccaacgcaaccatgatcaatagctttaataaatttccatacccgactcaggctgagctgtcctggttgaccgccgctagtaagcacccggaggaacacattcgtatatggttcgctacccagagattaaaacacgggattagctggtctcccgaggaggtcgaggaggccaggaagaagatgtttaacggcacaatacagagcgtaccgccaactattaccgtactcccagcacagttagccccaaccaaggtaacccagcctatccttcagactgctctgccctgccagatcttaggacagacctccctcgtgttgactcaggtgacatccggctccactacagtgtcatgctcccctattactcttgctgtggccggagtgaccaatcacggccaaaagaggcccctggtgactccacaggcggctcctgagcctaaacggccacatatcgcccaagtgccagaacccccaccaaaagtcgctaatccacccttgacccctgcatctgatcggaaaaagactaaggaacagattgcgcaccttaaggcttcattcctgcaatcccagtttcctgatgacgccgaggtgtatagactgatcgaggtcacggggctcgcaagaagcgaaataaaaaaatggttctcggatcacagatatcgctgccagcgcggaatcgtgcatatcacaagtgaatctcttgctaaggaccaattggctattgctgcatcccgccacggtcggacataccacgcttacccggattttgccccacaaaaattcaaagaaaagactcaaggccaggtgaaaatcctggaggactcgttccttaagagctcttttcctacgcaggccgaactggaccgtctccgcgttgagacgaaattgagccggagagagatcgactcttggttttccgaacgccgtaagctgagggactcaatggagcaagccgttctggattcaatgggttctggcaagaagggtcaggacgtgggcgctcctaatggtgctttaagcagactcgaccaattgagcggggctcagttgacttcctcgctaccaagtccttctccagccattgccaagtcacaggaacaggtgcacctgttgcgatccaccttcgcacggacacagtggcccacccctcaggaatacgatcagctggcagctaagactgggctggtgcgaactgaaatcgtgcgctggttcaaagaaaacagatgcctacttaaaactgggacagttaagtggatggagcaatatcagcatcaacccatggccgatgatcacggttatgacgctgtggccagaaaggccaccaaacccatggcggagtctccaaagaatgggggtgatgtggtgccgcaatactacaaagacccaaaaaagctgtgtgaagaggacctggaaaaactagtgaccagggtgaaggttggtagtgagcccgctaaagactgcctccccgcaaagccctcggaggctacgagcgaccggtcagaaggatcctcccgtgacggacagggatcagacgaaaatgaggagagctcagtggtagactatgtcgaggtgacagtgggcgaggaagacgccatatccgatcggagcgattcctggtctcaggcagccgctgagggtgtgtcagagctggccgaatccgattcagattgcgtgccggcagaagccggacaagcttag

SEQ ID NO: 56067 - DNA, 501 bp, Artificial Sequence
  Description of Artificial Sequence: Synthetic coding sequence
atggcctccaagagaaagtccacgacaccatgtatggtgcgaacgagtcaggtggtggaacaagacgtaccggaagaggtcgaccgcgctaaggagaagggaattggcactcctcagcccgatgtggccaaggattcttgggccgctgaattagaaaacagcagcaaggaaaatgaagtgatcgaagtcaagagcatgggagaatcacagagcaagaagctccagggcggatatgaatgcaagtactgtccatattctacccaaaatctcaacgaattcaccgaacacgtggacatgcagcatccaaatgtgattctgaaccctttatacgtatgcgccgaatgtaattttactacaaaaaagtatgattcactctccgaccataactccaaattccaccccggagaggcgaacttcaaactgaagctgatcaagagaaacaaccaaactgttctggagcagtcaattgagacaaccaatcatgtcgtctcaattacgtag

SEQ ID NO: 56068 - DNA, 465 bp, Artificial Sequence
  Description of Artificial Sequence: Synthetic coding sequence
atggccctgctcctctcagttttacgggtgctgttagggggattctttgcgcttgtggggctggcaaagcttagtgaggagatctccgcacccgtctccgagagaatgaatgcccttttcgtgcagtttgctgaggtctttccacttaaggtattcgggtatcaacccgatccgctgaattaccaaattgctgtcggcttcctggagcttctggctgggctgctcctagtcatgggacctccgatgttgcaggagataagcaatctttttctgatcctgctaatgatgggcgcaatcttcacgctggccgcattaaaggagagcctgtccacatgcattccagccatagtctgcttgggattcctcttgctcctgaacgtgggccagttactggcacagacgaagaaagtggtacggccaacaagaaaaaagaccctgtcaacatttaaagagagctggaaatag

SEQ ID NO: 56069 - DNA, 1296 bp, Artificial Sequence
  Description of Artificial Sequence: Synthetic coding sequence
atgatgctgagatttagcatgtgccggggaaatgatgagggcttcgccatggaacagatttggttgctcctgctgctgaccattcgtgttctgccaggcagcgcgcagtttaacggttataactgtgatgcgaatctccacagccggtttcccgctgagagggatatttcagtttattgtggggtacaggcaataaccatgaaaatcaacttctgtactgtactgttttcaggctatagcgagacagatttggccctgaatggacgccacggagactctcactgccgaggatttatcaataataatacatttcctgctgtcgttattttcatcatcaacttatcaaccctggaaggatgtgggaacaatctcgtggtgagtactatacctggagtttctgcgtatggcaatgccacaagtgtgcaggtaggcaacatctcaggctatatagacaccccagaccctcctaccatcatcagttacctgccaggtctcctctataaatttagttgctcttacccactggagtatttagttaataacactcagctcgcttcatcatcagcagcaataagcgtgcgtgagaataacggcacgttcgtaagtacgctgaacctgctgctctacaatgactccacttacaatcagcagctcatcataccctccattggactgccacttaagacaaaggtgtttgccgctgtgcaggctacaaatcttgatggtcggtggaatgttctcatggattactgctatacaacgccatccggaaacccaaacgacgacatccggtacgatttatttctttcgtgcgacaaggatccccaaacaacagttatagagaacgggcgatcccagcggggacgcttctctttcgaggtcttcaggttcgtaaagcataaaaaccagaaaatgtctaccgtcttcctgcattgcgtgactaagctctgtagggcggatgactgcccctttctcatgccgatatgttcgcacagggagagaagagacgcaggtcgacgtacaacgtggtccccacaatcgagttccggaagcgctgtgttatccgctggaccgattatcacccgcagcgatgaaactcccacgaataattcccagctcggctccccaagcatgccgccattccaactgaacgccatcacttccgctctgatctccggcatggtcattttgggtgtcacttctttttcattgctcctctgctctctggccctgcttcacaggaagggaccgacttcgttagtgcttaacggaattaggaaccctgtgttcgattag

SEQ ID NO: 56070 - DNA, 1248 bp, Artificial Sequence
  Description of Artificial Sequence: Synthetic coding sequence
atggagcagatatggctgctgctgctacttacgatacgcgtcctgcccggaagtgctcagttcaacggatacaactgcgatgccaatctgcattccagattcccagccgaacgtgatatctctgtctactgtggagtacaagctataactatgaagattaatttttgcactgtgctgttcagcggctactccgagaccgacctggctctgaatggtcgtcatggtgattctcactgccggggattcattaacaacaacacctttcccgctgtggtgatctttatcatcaatctgtccactttggaggggtgtggcaacaatctggttgtttctacaataccaggcgtttccgcttatggaaatgccacttcagtgcaggtcggcaacatcagcggctacatcgacacccccgacccgcctacaatcatttcctatctacctggtcttctttacaaattttcttgttcgtatccactggagtatctggtgaacaatactcagctagcctcttctagcgcggctattagcgtgcgtgagaataatggaactttcgtttcaactctgaacctgttgttatataatgactcaacctacaaccaacagcttatcatcccctccattggtctcccactgaaaaccaaagttttcgctgcagtccaagcgaccaatctggatgggagatggaatgttttaatggactattgttataccaccccctcaggcaacccaaacgacgacattagatacgatctgtttctcagttgtgataaggatcctcagactacagtcatcgagaacggtcggtctcaaaggggacgcttttccttcgaagtgtttagattcgtaaaacacaaaaaccagaaaatgtcaactgtgtttctgcactgcgtgactaaactctgtagggcggacgactgcccattcctcatgcccatctgcagtcatagggaaagacgcgatgcaggacggaggacaacgtggtccccacagtccagtagcggatccgcggtgctctctgccggaccaatcattactcgaagtgacgaaaccccaaccaataactcccagttaggcagcccctctatgcccccatttcagttaaacgctattacaagcgccctgattagtgggatggtgatcctcggcgtgacaagtttctccctgctgctgtgctccctcgccctgctgcatcgcaagggacccacatctttggtactgaatgggatccgcaaccctgtcttcgattag

SEQ ID NO: 56071 - DNA, 1248 bp, Artificial Sequence
  Description of Artificial Sequence: Synthetic coding sequence
atggagcagatttggctactgctactgcttacaatcagggtgctgcccggttctgctcaatttaacggctataattgtgacgcgaacctgcattcccggtttccagcagagagagacatctccgtgtattgcggggttcaggcaattacgatgaagatcaatttctgtactgttttgttttcaggctatagtgaaaccgatctcgccctgaacggcaggcatggggatagccattgtcgcggattcataaataataacacctttccagctgttgtgattttcattatcaatctgtcgacacttgaagggtgtggaaacaatctggttgtttcgactattcccggtgtcagcgcctatggtaacgccacctctgtccaggtcggcaacatcagcggctacatagacacccctgaccctcctactattataagctatttacccggactgctttataagttttcttgctcctaccctctggagtatctggtgaataatacccagctggcctcttcttctgcggctatctcagtccgggaaaataacggaacctttgtcagcaccctgaatttgttgctctataatgattccacctacaaccagcaactgataatcccctccataggcctgccacttaagacaaaagtgttcgcagcagtgcaggccaccaatttggacggaaggtggaacgttctcatggattactgctacacgacccccagcgggaaccccaatgacgacatcaggtacgacttatttctttcttgtgataaggacccccagacaacagtcatcgagaatgggagatcccagagaggccgattctcttttgaggtgttccgcttcgttaagcacaaaaaccaaaagatgagtaccgtgtttctgcattgcgtgacaaagctttgtcgggctgatgactgcccatttctgatgccaatttgctcacatagagaaagaagagatgcagggcgaagaactacttggtccccacagtctagctccggcagtgctgtcctctccgcaggtcctatcattacccgctcagacgagacacctaccaacaactcccagctcggctctccttccatgccacctttccagctaaacgcaatcacctccgcgctcatctcgggtatggtcatcttgggggttacatccttctccctgttgctgtgtagtctggccctactgcaccgaaaggggcctacgagtctggtcctcaacggcatcaggaaccccgtattcgactag

SEQ ID NO: 56072 - RNA, 1881 nt, Artificial Sequence
  Description of Artificial Sequence: Synthetic coding sequence
augguagccccauggagagucagugugcggguaugucuuagucaccuacggugcuucgaacuaaggcaggggcugagccugcugagacccagcgaaugcccccgggacgcucggcugugcuggcuuuuacuugggacuuugccuaaagugguaucacucugcggggacguaggggaaggugcuccugacguuuugucgaggcgucgugugcgauguagcggagccgcaggggccgguccugccgaaaguuugccgcgggcugggcccuuaggcggaguguuucuucaucuccgcuuguggcuaagagcaggcgcgcugcuggucaaauucuuuccucuccugcuccucuacccacucaccuacuuggcacccuccgucaguacauuauggcuacaucuucuucugaaagcuaccgaaaccaguggcccaacauacaucaagcucggacagugggcuaguacuagacgcgauuuguucagugaggcuuucugugcacaguuuaguaaacuucauguuagagucacgccgcacccuuggacacacacugaaagauucuugcggcaagccuuuggugaugacugggguucuaucuugucuuucgaaaacagggaacccgucgguucaggaugcgucgcacaaguguauaaagcauaugcuaauacagcguuccuagaaacagacaguguucagcgacugggccgugcuucuuguuuacccccguuuagccauacuggugccguggggggacugcgugagcuuuuugguuaccucgguaauggaagaaagcccccugaaaaucuggcugaccaaucguuccuggaaaggcugcugcuccccaaagcagaucugguggggucaaaugccggagugucucgagcccaggugcccggacaucagcccgaggcgaccaaucugauuuccguggccgugaaggucuugcacccuggacuacucgcccaagugcauauggaucugcugcugaugaagaucggcucucggguguuagguguccugcccggaauuaaguggcugucucugcccgagauagucgaagaauuugagaagcugauggugcagcaaaucgaucucagauaugaagcccagaacuuagagcauuuccaagucaauuuuaggaacgugaaggccgugaaguuucccacuccucugcggccuuucguaacccgcgaaguccuaguugagacuuacgaagaaagcguaccuguuucaucauaucagcaggccgggauccccgucgaccuaaagcgaaaaaucgccagauuaggcauuaacaugcuguuaaaaaugaucuucguggauaacuucgugcaugccgaucugcaccccgggaacauacuuguccagggggcaaauggccugaguagcucccaggaagcccagcuacagcaggccgacauuugcgauacacuggugguugcggugcccuccagccugugcccucugcggcugguucugcuagaugcuggaaucgucgcugagcuccaggcuccagauuuacguaacuuucgugcuguguucauggcgguggucaugggucagggucagaggguagcagaguugaucuugcaccaugcuagagcauccgaaugucgagacguggagggauucaaaaccgaaauggcuaugcuggucacccaagcucgcaaaaauaccaucacucuggagaagcugcaugugagcucccugcuauccaguguauuuaaacuccugaugacgcacaagguuaaacuggagaguaauuuugccagcaucguuuucgccauuauggugcuagagggccugggucgcuccuuagacccuaaacuggauauccuggaggccgcgcguccauuccugcucaccggacccgucuguccaccguag

SEQ ID NO: 56073 - RNA, 3699 nt, Artificial Sequence
  Description of Artificial Sequence: Synthetic coding sequence
auggcagaggcagcaaguggcgccgguggaaccucacucgagggagaacgcgguaagagaccaccaccggagggcgagcccgccgcuccagcaucuggggugcuugauaaguuauuuggaaagcgacuacuccaggcaggaagguaucugguaagucacaaagccuggaugaaaacagugccaacugagaacugugacguucugaugaccuucccagacacaacugacgaucacacccuuuugugguuacugaaucauauuagagucgggaucccugaacugauugugcaagugaggcaucaccgucauacacgggcuuaugccuuuuucgucacggccacguaugagagccugcuccggggugccgaugaauuaggccugagaaaagcggugaaggcggaauuugguggugggaccagagguuucucuugcgaagaggauuucaucuaugagaacguagaaagugaguugagguuuuuuaccagucaagaacgacaaagcauuauccgcuuuuggcugcaaaaccuucgcgcuaaacagggcgaagcuuugcacaacguccgcuucuuggaagaucagccgaucauuccugaacuggcagcaagagguauaauucagcaaguuuucccaguucaugagcagcguauccuaaacaggcugaugaaauccugggugcaggccgugugcgaaaaucagccucuugacgacaucugcgauuacuucggcgugaaaauugcgauguacuuugccuggcuuggguuuuauacgucagcaaugguguacccggcuguguuuggaagcguucuguacaccuucaccgaggccgaccagacaucccgugauguaaguugcgugguuuucgcccuauuuaauguuauuuggucaacucuauuccucgaagaguggaagcggaggggagcugaauuggccuauaaaugggggacucuggacucuccuggggaggcagucgaagaaccucgcccccaauuuagggggguaagaaggauuucuccuaucacucgcgcugaagaguuuuauuaucccccuuggaagcgacuguuguuccagcugcuagugucccucccccucugccucgcuugucuggugugcguuuuucugcugauguugggaugcuuccagcuccaggaacucgugcuuagcguuaagggacugccacggcuugcaagguuccuuccuaaggugauguuggcccuguuagugucugucucugccgaaggauauaagaaacuugccauuugguugaaugacauggagaacuauagacuggagagugcauacgaaaaacaccugaucauuaaggugguuuuguuccaguucgucaacuccuaccuuagccucuuuuauauuggcuucuaucucaaggauauggaaaggcugaaagagauguuggccacacugcuuaucacuaggcaguuucuccagaacgugagggaggugcuccagccucaccucuacagaagacugggcagaggggaacuaggccugagggcugucugggaguuggccagggcucuccucgggcuauugagccugcggcgccccgcaccacgucgucuagaaccacaggcggacgagggaggaggugguggaucaggcgggggcggccgacgauguuugucuggaggguguggcgccccagaggaggaagaagaggcagcgcugguugagcgcagacgagcgggcgaggguggcgaagagggggacgguccaccuggcggaaaagaggaggacgaagaugacgaagaggaagaggaugaggaagaggaggaggaugaagaagaaggcgaagaggggggccuacucgauuguggacuacggcuuaagaaggugagcuuugcugaacguggagcaggacggcgacggccaggcccaagccccgaggcccugcuggaagaaggcaguccaacaaugguagaaaaaggucuagagcccggcguguuuacucuugccgaagaagaugacgaggcagagggcgccccaggaagccccgaacgagagccuccugcaauccuguucaggagagcuggaggcgaaggccgggaccagggcccggacggggggcccgaucccgagccuggaagcaacagugacucgacccggcggcagcgcaggcagaacagaaguaguuggaucgacccucccgaagaagaacacucgccacagcucacacaggccgaacucgaaucauguaugaagaaauaugaggacaccuuccaggauuaucaggagauguucguucaguucggcuacguugugcucuucucauccgccuucccauuggcugcauuaugcgcccucgucaauaaccuuaucgagauuaggagcgacgcuuuuaaacuguguacuggccugcagcggccuuucggacagcguguagaguccaucgggcaguggcagaagguuauggaagccaugggcgugcuggcgauugucguuaauuguuaucugaucggccaaugugggcaauuacagaggcuguuccccuggcucaguccugaggcagcuauaguaagcgugguaguccuggagcacuuugcguuacugcugaaauauuugauucacguggcaauacccgauauaccuggauggguggcagaggaaauggccaaacuggaguaccagcgucgagaggccuuuaaacgucacgagaggcaggcacagcacagguaucagcagcagcagcgacggagacgagaggaggaggagagacaaagacaugccgaacaccaugccaggcgcgagcaugacucagguggcagggaagaggccagagcggaggggaguggccuggauccugcaacaucuucagagaaagcgagugcaaaagccaaagggucuaccgcggggggccacggaccagaacggccuaagaggccaggcucacugcuggcaccuaacaacguaaugaagcugaagcagaucauuccacugcaggguaaguuucugucuaguggugccaccuccucccucgcagccgcaggggcuggggccacaacaaggccucccccggcucagaguccuacuggaagcgacacucguuuaccugcauuccucucuuuuaaauuccugaaaagcccggagacacgcagggacagugagcgcucccacucccccccaaaggcauuccaugccggcaaauuauuuccauucggggggacgcgcgcagaaccagggucaaauggcgccggcggacaggcuaggcccgacgggacacccagcagcgguuccucgagagugcaaagaagcggcccaguggacgaagcacuugccgaagagcuugaggccccacguccagaagaagaaggaucuggcacagcacuggcaccugucggcgcaccagcacuucgcacccggaggaguaggagccccgcgccucccccacccaugccucuaccaaggccaccuaccccaccggcaggguguuggcagugggauggccccugggggugcgggggagagggagccgcuccacgacaggcccucgcggccgcugagugucccccaugugcuauggcggggccuccucccgccccucagccucucccuggagacgcaaguuuuuauucacucccuccucccccuuugccaccgacuucggacccccucgagacacccgcacccagccccucuccaaguccaaguccacaggcagucugcuggcccucagguuggcauuag

SEQ ID NO: 56074 - RNA, 726 nt, Artificial Sequence
  Description of Artificial Sequence: Synthetic coding sequence
augacucuucaaugggccgcaguggccacuuuccuguaugcugagaucgggcuuauccugaucuuuugcuugccguucaucccuccgcagcgauggcagaaaauauuuucuuucaacguguggggcaaaauugcaacuuuuuggaauaaagccuuucugacaauuaucauacuccuuauugugcucuuuuuggacgcuguucgggaagugagaaaauauucgucugugcauacaauagagaagaguucaacuucucggcccgacgcuuaugaacauacccagaugaagcucuucagaucccagcggaaccuguauauaucaggauuuaguuuauuuuuuugguuaguacuacggagacuuguuacccugauuacccagcuggcgaaggagcuaucuaauaaaggcguccugaaaacucaggcagaaaauacaaauaaagccgcuaaaaaguuuauggaagaaaacgagaagcucaaaagaauucugaaaucccacgggaaagacgaagaaugcguccuggaggcagagaauaagaaacugguggaggaccaggaaaagcugaagacggagcugcgcaagaccucugacgccuuaagcaaagcccaaaaugaugugauggaaaugaagaugcaaagcgagagguuaagcaaggaauaugaccagcuauuaaaagagcacuccgaacuucaggaccgccuagagagagggaauaaaaaaagacuguag

SEQ ID NO: 56075 - RNA, 1431 nt, Artificial Sequence
  Description of Artificial Sequence: Synthetic coding sequence
augggccggaaggaagaagacgacugcucuuccuggaaaaagcagaccacaaacaucagaaagaccuuuauuuucauggaggugcugggcucuggcgccuuuagugaagucuuuuugguaaagcagagacuuaccggcaaacuauucgcguuaaaaugcaucaaaaaauccccugcuuucagagauagcagucucgagaaugaaaucgcaguacuuaaaaagaucaaacaugaaaacaucgugacccuagaagacauuuaugagucaacaacacauuacuaccuggugaugcagcuugugaguggcggggagcucuuugaccggaucuuggaaagagggguuuacacggaaaaggaugcuucacugguuauacagcagguccucuccgccgugaaguaccuccacgagaauggcaucguucacagagaucugaagccagagaaucugcuuuaccugaccccugaggaaaauuccaaaauaaugaucacugacuucggacugucaaagauggagcagaacggcauaaugucaacugccugcggaaccccuggcuacguagcucccgagguacucgcacagaagcccuacagcaaggcaguggacuguuggucaaucggugucaucacauauauucugcucugcggguauccacccuucuaugaggagacugagucaaaacuguucgagaaaaucaaagaggguuauuaugaauucgagaguccguucugggaugacauauccgagucagcaaaagacuucaucugucaccuucuggaaaaagacccuaacgaacguuauacaugugaaaaggcucuuucccauccauggauugacgggaacacugcacuacaccgugauaucuacccaagcguuuccuugcagauccagaaaaauuuugccaagaguaaauggaggcaagcguuuaacgccgcugcagucgugcaucacaugcggaaauuacacaugaaccugcacucaccaggcgugcggcccgaaguugaaaacaggccaccagagacccaagcauccgagacgagucgacccucaagcccggagauuaccauaaccgaggcaccuguacuugaucauucugucgcauuacccgcucugacucaauugcccugucagcauggacgccgucccacugccccuggcggucgcucgcugaacugccuaguaaacggaucucuucacaucagcucgagcuuagugccuaugcaucaagguuccuuggccgccgggccuuguggcugcugcagcuccugucugaauauagggagcaagggcaaaucuucauacuguagcgagccuacacucuugaagaaggcgaacaaaaaacagaauuuuaaauccgaagugauggucccggugaaagcuucuggauccagccauugccgggccggucagacuggcgugugccuuaucauguag

SEQ ID NO: 56076 - RNA, 3750 nt, Artificial Sequence
  Description of Artificial Sequence: Synthetic coding sequence
auggucgaggcagccccuccagguccugggcccuuaaggagaacauuucuggugcccgagaucaagucauuggaucaguaugacuucucgagagcuaaagcugccgccagccucgcgugggugcugcgcgcugcuuuugguggcgcugaacaugugccuccagaacugugggagccauuuuacacugaucaauaugcccaggagcaugucaaacccccuguuacccgucuguuacuguccgcagagcuguacugucgugccuggaggcaggcacuaccgcaguuggagacaccgcccaaucccucagcgcugcuggcccugcuggcucgacgaggcaccgugccugcauuaccagaaaggccuguucgcgaagcugaccugcgucaccagccaauccucaugggcgcgcaucuggccguuauagacgccuugauggccgcuuuugccuuugaauggaccaagacccugccaggcccccuugcccuuaccagccuggagcacaaguuguuauucuggguggacacuacugugcgcagacugcaggagaaaacugaacaggaggcugcacagagagcgucuccugcugcucccgcagauggcgcagccccagcccagccaagcaucagauauaggaaggaccgagucgucgccagaagggccccaugcuuuccaacagugacaucucuccaagaccuggcuagcggggcugcccuggccgcuaccauucacugcuauugcccacaguugcuccgccuggaagaggugugccugaaagauccuaugucaguagcagauucccuguauaacuuacaacugguccaggacuucugcgccucucggcucccucggggcuguccacugucccuggaggaucuccuuuaugugccacccccauugaaggugaaucuuguggucaugcuggcugaguuguuuaugugcuuugaggucuugaaaccugauuuugugcaggucaaagauuuaccggauggccacgccgccagcccgagaggcaccgaagccaguccuccccagaauaauagcggcucaucuucucccguguucacauuccgucauccuuuacucucaucugggggcccccagagcccccugaggggcaguaccggcagccuaaagaguucgccaagcaugagccacauggaagcucucggcaaggcuuggaacaggcagcugagucggccucugagucaggccgugaguuucuccacaccauuuggucuggauuccgacguugacgucguaaugggcgaucccgugcuucugagguccguuaguucggacagccugggcccaccccggccagcuccagcacgaacgccuacacagcccccccccgagccaggagaucugcccacaauugaggaagcccuccagauuauucacucagccgaaccuagauuguuacccgacggcgccgccgaugggaguuucuauuuacauucccccgaaggucccucuaaaccaucccuagcuuccccuuaccugccagaagggacgucaaaaccgcuguccgacagaccaaccaaggccccuguguauaugccccauccagagaccccuucaaagccaucaccuugucucgucggugaggccucuaaaccaccagcucccagcgagggcagccccaaagccguggccucuucaccggccgccacuaacagcgaggugaagaugaccuccuucgccgagaggaagaaacaguuagugaaagccgaagccgaggcuggggcugguucuccuacuuccacaccugcucccccagaggcccugucuagugagaugucugagcuaucggcgcgacucgaggagaagcgcagggccauugaggcucagaagagacguauugaggcaaucuucgcaaaacacagacagcguuuggggaagucggcguucuuacaggugcagccccgcgaagccuccggggaggccgaagccgaagccgaggaagcagacucagguccugugcccgguggugaaagaccagccggugaagggcaaggggagccgaccagcagaccuaaagcugugacguucagcccagaucugggaccgguuccccacgaggggcuaggagaguauaauagggcaguguccaaacugagcgcagcacugucaagccuccagcgugauaugcagcguuugacagaccagcaacaaagacuucucgcuccuccugaggcaccggggucugcuccgcccccagcagcuugggugaucccagggccuacuaccggcccaaaagcugcuagcccgagcccugcuagacgagugcccgcaacgcggagaucaccugggccaggcccuucacagaguccacguucccccaagcacaccagaccugcugaacugcgucuugcuccacuaacacgcguccucacacccccacacgauguagacucacucccccauuuaagaaaguucucaccaucacagguuccaguccagacacguuccagcauccugcuugccgaggagacaccuccugaagagccugccgccaggccaggacuuauagagaucccguugggaucccuggccgauccagccgcugaggaugaaggcgauggaagcccugccggcgccgaggacucucucgaagaggaagccagcucugaaggggagccacgggugggauuaggcuucuuuuacaaagacgaggacaagcccgaggacgaaauggcacagaaaagagcuagccugcuagagaggcagcagcgaagggccgaagaagccagacggcgcaaacaguggcaagaaguggagaaagaacagcgacgugaggaggcugcucgacucgcucaggaggaggccccgggcccugcgccccucguauccgccgugccgauggccacuccugcaccugccgcuagggcuccugccgaggaagaaguuggaccuaggaaaggcgauuucaccaggcaagaguacgagaggcgagcccaauugaagcucauggaugaccuggauaaaguacuccgccccagagcugccgguagcgguggacccgggcggggcggaagacgcgccacgcgccccagaagcggcuguugcgaugauuccgcauuagcaaggucuccagcuagggggcugcugggaucccgguuguccaaaaucuacucacaauccacguugagccugagcacuguagcaaacgaagcacauaacaaucucggcgugaagcguccaaccagucgugcucccuccccaaguggacugaugucucccucgagacucccugggagcagagagcgugauugggaaaacggcagcaacgcuucaagccccgcaucuguaccagaauauacuggcccccggcuguacaaagaaccgagcgccaaguccaauaaguucaucauacauaaugccuugucccacuguugucuagcuggcaagguuaacgagccacaaaaaaaucgcauauuagaggaaaucgagaaaagcaaggcuaaucacuuucugauccuguucagggauucaagcugucaauucagagcgcuguacacacucucuggagagacugaagaacugagccgguuagcaggguaugguccuagaacggucaccccagcaaugguggaaggcauuuacaaguacaauucagaccggaagagauucacccagauuccugcaaaaaccauguccaugucgguggacgccuuuaccauccaaggccaccuguggcaagggaagaagccuaccacuccuaagaagggcggugguacaccaaaauag

SEQ ID NO: 56077 - RNA, 798 nt, Artificial Sequence
  Description of Artificial Sequence: Synthetic coding sequence
auggguuccccauccgccugccccuaccgaguaugcauccccuggcagggucuucucuugacugcuucgcuucugacauuuuggaaccugcccaacucagcacagacuaauauugacguggugccuuuuaauguagcugaaggaaaggagguuuugcuggugguccacaaugaaucucagaacuuauacggcuacaauugguacaaaggagaacgggugcacgccaacuaucggauuauuggguaugugaagaacaucucccaggaaaaugcuccagggcccgcacacaauggcagagaaaccaucuaucccaaugguacacugcuuauccaaaauguaacacauaacgacgcugguuucuacacacuccacguaauuaaagagaaucucgucaaugaggaggugacuagacaauuuuacguguucagcgaaccuccaaagccaaguauuacauccaacaacuuuaaccccgucgagaacaaagacauugucguucucacuugucagcccgaaacccagaacaccaccuaccuguggugggugaauaaccagucacuccucgucaguccuaggcugcuguuauccaccgacaaccguacccugguccucuugucugccacuaagaaugacaucggcccuuaugagugcgaaauccaaaacccggugggcgcaucacgcucagacccagucacacuuaaugugcgauaugagucaguccaagcgaguuccccagaccugucggccggcacugccgucagcauaaugauuggagucuuagcugguauggcucugaucuag

SEQ ID NO: 56078 - RNA, 1182 nt, Artificial Sequence
  Description of Artificial Sequence: Synthetic coding sequence
auguacgccugguucuuucugccguccuuuucccagucgccucccacauucggguuucuucucgacauugaugggguucugguccgagggcaucgggucaucccggcagcuuuaaaagcguuucgcagguuggugaauucccaaggucaacugcgggugccgguugucuuugugacgaacgcuggcaauauucugcagcacucaaaagcccaggaacugucagcguugcuggggugugaaguggacgcagaccagguuauccugucccacucaccuaugaaacuguucagcgaguaccacgaaaaaagaauguugguaucuggacagggccccgugauggagaacgcucaggggcuggguuuucggaauguggugacgguggacgaacucagaauggccuucccucuccucgauaugguggaucuggaaagaaggcuuaagacuacuccacugccucgcaaugacuucccuagaauugagggagugcuucuauugggggaacccguccgaugggaaaccagccuucagcucauuauggaugugcuucugagcaacgggagccccggcgcggguuuggcaaccccccccuauccccaccuaccuguccuugccaguaauauggaucuucucuggauggcugaagcaaaaaugccacgauuuggccauggcaccuuucuguugugccucgagacuauuuaccagaaggucacuggcaaagagcuucgcuacgaaggcuuaauggggaagccauccauucucacuuaucaguaugcagaggauuuaauucgcagacaggccgaacggagggguugggccgccccuaucagaaagcuguaugccgugggagauaaucccaugucagacguuuacggggcuaacuuguuucaccaguaucugcagaaagcaacucacgauggugcccccgagcucggcgccggaggaacuagacagcagcaaccgucugccucucaaucuuguauuucuauucuagugugcacugguguuuauaacccccgcaacccucaaucaacugagccgguucugggcggaggcgagccccccuuccacggacaucgcgaucuaugcuuuucuccaggguuaauggaagcuucucacguggucaaugacgucaacgaagccguucagcuugucuucagaaaagaaggcugggcccucgaauag

SEQ ID NO: 56079 - RNA, 1326 nt, Artificial Sequence
  Description of Artificial Sequence: Synthetic coding sequence
augagugugcugcugcguucuggacuuggcccuuugugugcaguagccagagcugcaauuccuuuuauuuggcgggguaaauacuucaguagcgggaaugagccagcugagaaccccgugacaccuauguugagacacuugauguauaaaaucaaaucaaccggcccaauuaccguggcugaauacaugaaggaaguguuaaccaacccugcuaagggauacuauguguauagagauaugcugggggaaaaaggugauuucauuacuucacccgagaucagucagauuuuuggagaacuccugggaauuugguucaucucagaauggauggcaacgggcaagaguacugcauuccagcucgucgaacucggcccuggaagaggaacccugguaggcgacauacugagagucuucacccaacugggcagcguucugaagaacugcgacauuucuguacaccugguugaggugucacagaaacuguccgaaauucaagcacugacucugaccaaagagaaggugccucuugagagaaacgccgggucuccaguuuacaugaaaggaguaaccaaaagcgggauacccaucuccugguaucgggauuugcaugacguaccuaagggguauagcuuuuaucuggcacaugaguucuuugaugucuugcccguucauaaauuccaaaaaacaccacaaggcuggcgggaggucuucgucgauaucgauccccagguuucagacaaauugcgguucguuuuggcacccucagccaccccugcugaagcguucauucaacacgacgagacacgagaucacguugaaguuugccccgacgccggcgugauuauagaggagcugucccaacgcauagcuuuaacaggcggugccgcacuaguugccgacuauggacacgauggaacaaagacggacacuuucagaggguuuugugaucacaaacugcacgacgugcugaucgcgccugguaccgcugaccucaccgccgacguagauuuuucauaucugcggcgcauggcccagggaaaaguagcaucucugggucccauuaagcagcacacauucuuaaagaacaugggaaucgacgugcggcugaagguacuacuagacaaauccaacgagcccaguguaaggcagcaguugcugcagggguacgacaugcucaugaacccaaagaaaaugggugaacgauuuaauuuuuuugcacuacuuccacaucagagauuacagggggggcgguaccagcgcaaugcgcggcaaucgaaacccuucgccucggucguggcaggcuuuagcgaacucgccuggcaguag

SEQ ID NO: 56080 - RNA, 1539 nt, Artificial Sequence
  Description of Artificial Sequence: Synthetic coding sequence
augcuuuuugaaggucuggaccugguuagcgcccuggccacccucgcggcuugccugguaucuguaacacuccugcuggcgguuucacagcagcuauggcaguugagaugggcagcaacgcgggauaaauccuguaaguugccaauucccaagggauccaugggcuucccacuaaucggagagaccggucacugguuauuacagggaaguggauuccaaucuucacggcgcgagaaauauggaaacgucuucaagacucaucugcuuggaagaccucugauucgggugaccggggccgagaauguccgcaaaauccugaugggcgaacaccaccuggugucaaccgaauggccgcgaagcacacggaugcuccucgguccgaacacuguguccaauucaaucggcgacauccacagaaauaagagaaagguguuuagcaagaucuuuagccacgaagcguuggaaagcuaccucccuaagauacaacuugugauccaggacacacucagagccugguccucccauccugaggcuauaaacguguaccaggaagcccaaaagcucaccuuccguauggccauucgaguccuccugggcuucagcauccccgaggaggaccuuggacaccuauucgaaguguaucaacaguuuguugauaacgucuucuccuugccuguggaccugcccuucaguggauacagaaggggcauucaagcaagacaaauccuccaaaaaggacuggaaaaagcaauccgagagaaacugcaguguacgcaaggcaaagacuaccuggacgcucucgaucugcucaucgaaagcucuaaggaacacggcaaggaaaugacaaugcaggaacuuaaggacggcacacuggaacucaucuucgcugcauacgcaacaacagcaucagcuucaaccucucugaucaugcaacugcugaagcauccuacaguucucgaaaagcugcgcgaugaguugagagcccacggaauuuugcacucaggcgggugcccaugugagggaacgcucaggcuggacacacugaguggacuccgcuaucucgauugcgucauuaaagaggucaugaggcuguuuaccccuauuagugguggauauagaaccguccuccagacauuugagcucgacggcuuccagauucccaaaggcuggagugucauguauucaauuagggauacccaugauaccgcacccguuuuuaaggaugucaacguguucgaccccgacagguuuucucaggcucguagugaagacaaggauggccgguuccauuacuuaccuuucggugguggggugcgcacaugucucgguaagcaucuggcuaaacuguuuuugaaggugcuggcgguggaguuagcaucaaccuccagguucgagcuagcgacccggacuuuuccaaggaucacacuggugccaguucuccacccgguugauggccuuucugucaaauuuuuuggacucgacucuaaucagaacgaaaucuuaccugagacugaagcaaugcugagcgcaacuguguag

SEQ ID NO: 56081 - RNA, 573 nt, Artificial Sequence
  Description of Artificial Sequence: Synthetic coding sequence
augcugacuccagccuuccacuuuaacauucucaaacccuacaugaagauuuuuaacgaauccguaaacaucaugcacgcaaaauggcaauugcuggccuccgagggauccgccugcuuggauauguucgagcauauauccuugaugaccuuggacucccugcaaaagugcguguucuccuucgauucccacugccaagagaagccaagcgaauacaucgccgcaauucuagagcuaagugccuugguuagcaaaagacaccacgaaauuuuguugcacauagauuuucuguauuaucucaccccagauggucaacgguuucggcgcgccugccgauugguccacgauuuuacagacgccgugauccaagaaaggagacggacgcuuccuagccaaggagucgaugacuuucuccaggcaaaggcuaaaaguaagacgcuggacuuuauugauguccugcuccucucuaaagcuaugacaccucggccugucguuucccccggcuccugcaccacacuccaguccacccaaaauacaagaagugcugcaggccgucgcugcaagaauuuuuag

SEQ ID NO: 56082 - RNA, 720 nt, Artificial Sequence
  Description of Artificial Sequence: Synthetic coding sequence
auggcauaucagucacugagacuugaguaucuucagaucccaccuguaucuagagcguauaccaccgcguguguacuaacgacugccgccgugcagcuagagcucauuacaccuuuucagcuuuauuucaacccugaguuaaucuucaaacacuuccagauauggcgccugauaacuaacuuucucuucuuuggccccguggguuuuaauuuccucuucaauaugaucuuccuuuaucguuacugccgcaugcucgaggagggcagcuuuaggggaaggacugcugauuucgucuuuauguuccuuuucggugguuuccugaugacacucuuuggccuguuugugucucuggucuuucuaggucaggcuuuuacaauaaugcucguauacguuuggucccgcaggaauccuuauguuagaaugaauuucuucgguuugcugaacuuucaggcgccauuccugccuuggguucugaugggcuucagccugcuguuaggcaacucaaucauaguggaccugcuaggaaucgcugucggucacauuuauuucuuucuagaggaugucuucccuaaccaaccagggggaauuaggaucuuaaagacuccuucuaucuugaaagccaucuucgacacucccgaugaggaucccaauuacaauccacugcccgaggaaagacccggaggauuugccuggggagaggggcagcggcugggcggcuag

SEQ ID NO: 56083 - RNA, 2211 nt, Artificial Sequence
  Description of Artificial Sequence: Synthetic coding sequence
auggccgggaguucuacuggcggaggaggcgugggcgagacuaaagugaucuaccaucuggaugaagaggaaacaccauauuuaguuaaaauuccugugcccgccgagaggaucacccuaggugauuucaagagcguguugcaacgcccagcuggggcaaaauacuuuuucaagucuauggaccaggacuuuggcguggugaaggaggagaucuccgaugauaaugcacgucuacccuguuuuaauggacgggugguaagcuggcugguuagcagcgauaauccacaaccugaaauggcuccaccaguacacgaaccccgggcugaacuugccccucccgcgccaccccuccccccucuuccucccgagcguacuagcggcauuggggacuccagacccccuagcuuucacccuaaugucagcaguucccacgaaaaccuggaaccugagaccgagaccgagucggugguaucccuccgcagggaaagacccagaagacgugacucuagcgagcauggcgcuggcggccaucgcacuggcggaccuucuaggcuggagcgccauuuagcaggcuacgagucaucaagcacacucaugaccuccgagcuugaguccacaagcuuaggcgacucagacgaagaagauacaaugucccgauucuccuccaguaccgagcagagcuccgcuagccgccuccuaaagagacaccgcagaaggaggaagcagcgaccgcccagacuggagcgcacaucaucuuuuagcaguguaaccgauucuaccauguccuugaauaucauaacuguaaccuuaaauauggagaaauauaacuuucugggcauaagcauugugggucaauccaaugaaaggggagacggcgggauuuauauaggcuccauuaugaagggcggugcaguggcagccgacgguagaauugaaccaggggacaugcuuuugcaggucaacgauaugaauuuugagaauaugaguaaugacgacgcagugcgggugcuuagagacauaguccacaagccgggcccuaucgugcucacagucgccaagugcugggaucccagcccucaggcuuauuuuacccucccacgcaacgagcccauucagcccaucgauccugcagccuggguaucccacuccgccgcgcugacagguacauucccugcuuacccggguucaucguccaugagcacaaucaccucagggucuagucugccagacgggugugaaggucgagggcucaguguucacacggacauggcgagcguuacuaaggcuauggcggcaccugagucugggcuggaggucagagaucguauguggcugaaaaucaccauuccaaaugcuuuccuggggucugaugucguggacuggcuguaucaccacguggaaggguuccccgaacgccgcgaagcuagaaaguacgcaucagguuugcugaaagccgggcucaucagacacacaguaaauaaaaucacauucagugagcaguguuacuauguguuuggcgacuuauccggcggaugcgaaucuuaucucgugaauuugucacugaaugacaacgaugggucgagcggagcuagcgaucaagauacgcuugccccccuccccggagcaacuccauggccucuccugcccacauucucguaucaguaucccgcaccccauccguauucuccccagccaccaccauaccacgagcugaguagcuauacuuaugggggcggaucugccaguagccagcacagugaaggcucaagaagcagcgggucuacccgaagugacgggggugccggaagaaccggucgcccagaagagcgggcaccagaaucaaaauccggcucaggcagcgaaagcgagcccucuucccguggagguucccuccggcgggggggagaagccagcgggacaagcgacggcggccccccccccagcagaggcucgaccgguggcgccccaaaccuccgugcucaccccggccuucaucccuauggcccgcccccagguauggcauugcccuauaauccaaugaugguggucaugaugccgcccccgccuccuccuguaccuccagcagugcagccuccuggggccccgccagucagagaccucggguccgucccuccugaacugaccgccucccgacaaucuuuucauauggcgaugggcaaccccucggaguuuuuugucgaugugauguag

SEQ ID NO: 56084 - RNA, 462 nt, Artificial Sequence
  Description of Artificial Sequence: Synthetic coding sequence
augagugagauccagggaacgguugaauucuccgucgagcuucauaaauucuauaacguugaccuguuucagagaggguauuaucagauacgcgugacccugaaggucucaucacggaucccgcaucgacucucugccaguaucgccggacagacugaaucuuccucacuacacucagccugugugcaugauuccaccguucacagccggguguuccagauccucuauaggaacgaagaaguuccaaucaacgacgccguuguguucagggugcaccuccugcuaggaggggaaagaauggaagaugcccucagcgaaguugacuuccaacucaaaguggaccugcauuucacugacuccgagcagcaacuaagagacguggccggcgcuccgaugguaucaagucgaacucuaggacuucacuuucacccgcggaauggucugcaccaccaggugcccuag

SEQ ID NO: 56085 - RNA, 1074 nt, Artificial Sequence
  Description of Artificial Sequence: Synthetic coding sequence
auggcaacaaccgugccugauggcuguaggaacgggcuaaaaucgaaauauuaucgccugugugauaaagcagaggccugggggauuguacuagaaacaguagcgacugccggcgucgugacaagcguagcuuucauguugacacugccaauuuugguauguaaggugcaagacaguaacaggcgcaagauguuacccacccaguuucuguuccuucuaggggugcucgggaucuucggccucaccuucgcuuuuaucaucggccuggauggaucaacuggaccuacuagguucuucuuguucgggauccuguuuucaaucugcuucucaugccuccucgcccacgccguuagucuaacuaagcugguccgggggcggaaaccccugagucuucuugugauccuaggacuugcggugggcuuuagccucguacaggacguuauugcaauagaauacaucgugcugaccaugaaucgaacuaauguaaauguguucuccgagcuuagugccccaagacgaaaugaagauuuuguccuacuuuuaacauacguccuauucuuaauggcccugaccuuccuaaugaguucguucacauuuuguggaucguuuacuggguggaaaagacacggagcucacaucuaccuuaccaugcuucuuucaauugcuaucugggucgcauggaucacacuccucauguugccugauuucgaucggagaugggaugauacuauacugagcucugcccucgccgcaaacggguggguguuucucuuggcguacgugucgccagaguuuuggcugcucacaaagcagcguaaucccauggacuacccuguugaagacgccuuuugcaaaccgcagcuggucaaaaagucauauggcguggaaaauagagccuacucccaggaggaaauaacccaaggcuucgaagagacaggcgauacccucuaugcucccuacuccacgcauuuucagcuccagaaucagccuccacagaaggaauucuccaucccgcgcgcacaugccuggcccaguccguacaaggauuaugagguuaaaaaagaaggauccuag

SEQ ID NO: 56086 - RNA, 1149 nt, Artificial Sequence
  Description of Artificial Sequence: Synthetic coding sequence
augagguccggaggucggggaaggccucggcugcgccugggagagcgcggucuuauggaaccccuccugccacccaaacgucgacuacugccacgcguaaggcuccuucccuuguugcuggcccuugcuguaggaucugccuuuuauaccaucugguccggauggcaucggcgaacagaggaacugccacuuggcagagaacugcgcgugccccugaucggaucccucccagaagcccgacucaggagggugguuggacaacucgacccucagcgucucuggagcacuuaucugagaccacuucuggucguccggaccccugggagcccuggaaaucuucaaguccgcaaguuucuggaagccacacuuaggucacuaacugcaggcuggcacguugaacucgacccauucacugccagcaccccccuaggaccuguagacuucggcaacgucgucgcaacccuugaccccagggcagcccggcaccucacuuuggcuugccauuacgauuccaaauuguuuccgccaggcucuaccccauucgugggcgcuacggauuccgccguaccuugcgcacugcuguuggaacucgcccaggcgcuugacuuggagcucagcagggccaaaaaacaagccgcccccgucacccugcagcucuuauuccuugacggagaggaggcguugaaagaguggggaccuaaagacucucuguaugguuccagacaccuugcccagcucauggagagcaucccccacagccccggcccaacccgaauucaagcaaucgaacuauuuaugcuauuagaccuuuugggugcucccaaccccacauucuacagccacuuuccucgaacaguccgcugguuucaccggcuccgauccauugagaagaggcuucaucgcuuaaaccuccuccagagccacccucaggaggugauguacuuucagcccggggagccauuuggcaguguggaagacgaucacauuccauuccuuaggagaggcgugccuguacuucaccugauuucuacaccauucccugcugucuggcauacccccgcagacacugaggucaaucugcacccuccaacugugcauaaucuuuguagaauucucgccguguuucuggccgaguauuuaggacuguag

SEQ ID NO: 56087 - RNA, 924 nt, Artificial Sequence
  Description of Artificial Sequence: Synthetic coding sequence
auggccgccuuguuacuuggagcuguucugcuuguugcccagccucaacuugucccgucuagacccgcagaguugggccagcaggagcugcugcgcaaagcugguacauugcaagacgauguucgcgauggagucgcgccuaacggguccgcacaacagcucccucagacaauuaucauagggguccgaaagggcgguacacgcgcucuucucgaaaugcugagucugcacccugacguugcugccgccgagaaugaaguccacuuuuucgacugggaagagcacuauucucauggacugggcugguaccuaucacaaaugcccuucucauggccacaccagcugacagucgaaaagacuccugccuauuuuaccagcccuaagguccccgaacgaguuuauaguaugaacccaagcauuagguuauuacucauucucagggaucccuccgagcgaguccugagugauuauacccagguuuuuuauaaccauaugcaaaagcauaaacccuaccccucuaucgaggaguucuuaguucgcgauggacggcugaacguagacuauaaagcccucaaccgcagccuuuaccauguacacaugcagaacuggcucagguuuuucccacugcgccauauucacauuguugauggagaccggcuaauccgagauccuuucccagaaauccagaaggucgagagauuucugaagcugagcccucagaucaaugcaucgaacuucuauuuuaauaaaacuaaagguuucuacuguuuaagagauucgggcagagauagaugccugcaugaguccaaagggagggcccacccacaaguugauccuaagcugcugaacaagcuccacgaguacuuccaugaaccuaacaagaaauucuuugaguuagucggaagaaccuucgauuggcauuag

SEQ ID NO: 56088 - RNA, 975 nt, Artificial Sequence
  Description of Artificial Sequence: Synthetic coding sequence
augcugcugggggagcuuggaguauuugcuucuuaugccuuugccccucucucccugaucgugccauuaucugcuguaagcguuaucgcauccgccaucauagggauuaucuucauuaaagagaaguggaaacccaaagacuuccuccgccgauaugugcucuccuucguugggugcggauuggcuguugugggcacauaucuccucgugaccuuugcaccuaauagccacgaaaagaugacaggcgaaaaugugaccaggcauuuggugagcuggccauuccuguuauauaugcuggucgagauaauccuauucugucuuuugcuguacuucuauaaggaaaaaaaugccaacaacauagucgugauucugcuccucgucgcacugcuuggcucaaugaccguggucacugucaaggccgucgccggcaugcucguccuguccauucaggguaacuugcagcucgacuacccgaucuucuacguaauguuugucugcaugguggccacugccgucuaccaagcugccuucuuaucucaggcuucccagauguacgacucgucucuuaucgccucaguggguuauauccuaagcacuacuauagcgauuaccgcaggcgcuaucuuuuacuuggauuucaucggagaagauguauuacacaucuguauguuugcucugggcugucucauugcuuuuuuggggguguuccuuauuacccggaacaggaaaaaaccuauuccuuucgagccauauauuagcauggaugccaugcccggaaugcagaacaugcaugauaaggggaugacagugcagcccgaacucaaagcuucguuuuccuacggcgcacuugagaauaaugauaacaucucugagauuuacgcaccagcuacacuuccagugaugcaggaagaacauggcucucguagugcuuccggagugcccuauagagucuuggaacauacaaagaaagaauag

SEQ ID NO: 56089 - RNA, 2283 nt, Artificial Sequence
  Description of Artificial Sequence: Synthetic coding sequence
augguucuuaaagcguucuuuccaacuuguugcgugagcaccgauaguggcuuguuggucggaagguggguaccagagcaaucuucggcuguggugcuggccgugcugcacuuuccauucaucccuauucaggugaagcaacuuuuagcccagguuagacaggcuucacaaguagguguggcaguacuuggcaccuggugccauugccgacaggagccagaagaauccuuagggagauucuuagaaagcuugggugccguuuuuccccacgaaccuuggcugcggcugugcagggaaagggggggaaccuuuuggagcugcgaggccacccacagacaggccccgaccgcucccggcgcuccuggagaggaucaggugauguuaauauucuaugaccagagacagguacuucuuucucagcuccaccugccaacaguucugcccgaccgacaggcuggggcaacaaccgcaucuacuggagggcuggcagcggucuuugacacaguggcaagauccgagguguuauuucgaucagaccgguuugaugagggacccguccgguuaucucacuggcagucugagggggucgaagcuaguauccucgccgagcuggcucggcgcgcuucaggccccauuugccugcugcuugccucucuguuaagccucgucucugccgugucagcguguagaguuuuuaaacuguggccgcuguccuuuuuaggcucaaagcuuuccacuugcgaacaacugaggcacagacuggaacauuuaacacuuauauucuccacccgaaaggcagaaaaucccgcccaacuuaugagaaaggcuaauacaguggcaagcguccucuuagauguugcacucgguuuaaugcuguuguccuggcuucauggccggagccgcauugggcaccuagcagaugcacuuguaccaguugccgaccacgucgcugaagaguugcagcaucuccugcaguggcugaugggagcuccugcggggcugaaaaugaauagggcacucgaucaggugcuggguagguuuuucuuguaccacauacaccuuuggauaaguuacauccaccuuaugucccccuuugucgaacacauucuguggcaugugggucucucugccugucuuggacuuaccguggcucugucccugcucuccgauauuaucgcacuccuuacguuccacauuuauuguuucuacgucuacggugcgcggcuguacugucucaagauacacggacuuagcucgcuguggcgguuguuuagagggaaaaaguggaaugugcugcgacagagaguagacagcugcucauaugaccuggaccaguuauuuaucggaacacuacuguucaccauccugcuguuccugcuucccacaaccgcccucuauuacuuggucuuuacccugcuccgccuccuggugguggcaguucaagggcugauucauuuacuggucgaucucauaaacucucugccuuuguacagucuugggcugcggcuuugccgcccauaucgauuggcugacaagccgacagcguuacagcccagaggcgcucaccugccccccccccaacuaugguuacccccccaggcguugcuuggccggccugugccgcaggcagucccuuggggagcccaccucccccuugaggcagagagaggacaggcaggcuuacgggagcuccuggcucggcuggcacccccucacggccauagucaaccauccgccuugccuggcuggcaccaacucucguggcguaugucaugugcacucuggacccuccugugcgcucccgagcauggccggccaugcuaccauacccuagggcuugaaguaauugguagugagcaaauguggggcuggccagcgcggcuugccgcucuucaccacuggcauugccucccuugggacccucugccuaccugcuguggucaucaugggggcgaacacucuaacccacgaugcccugaacauuguccaaugcccacccugugcacucaggugcagagagucagaccaccucagcagccucaaguugaggguuggucuccgugggggcuucccucugguuccgcgcuggcagugggaguagaggguccuugccaggacgaaccaccuucaccgagacacccgcucgcucccagcgcugagcagcaccccgccucugggggcuugaagcagagccuaaccccuguaccuaguggaccgggccccagccugccggaaccccauggcgucuauuuacgcauguuuccuggcgaaguggcccuguag

SEQ ID NO: 56090 - RNA, 2400 nt, Artificial Sequence
  Description of Artificial Sequence: Synthetic coding sequence
auggcccgaacugccccaguugaaccgccucuacggcacagugcucccccaucuccugcugcaggugaaccuagaacuagcgucgaagcagcgguggccccacggcguguccuuuuugcugacgaagcucuuggauuaccacucgcacagcugcggagguaccguccuuggggcggcccaggagccgggaaaauggcugcagcugcagggcaagacggcgggggaggagguggggcugacgaagaugaugauggugaggacggcgaugagggagaggaggaggaagaagccugcccagagcccucuccccuauguccuguaccugcuggugggggcuucuaccugguuccuacguuuucucucccacccgcccccggaagacucgagaggcucggcagagugaugguugaauuagaagcgcuguuaccuccuccaggagccgugcccggcggugcaggcguuuggguccccgggggacggccgccaguguuacgcggucuuguaagaguacugaaccgaucauuugagaaagccguucaugugcgggcaucccacgacggcugggcauccuuuugugaucaccccgcacgcuauguacccagaagcccaccgugggcuggagccggcggaacaggcgccggugaccccauccuggaucccggcuuaggccucggcccugggcaagccagcgccuccucaccagacgacggcggucgcacugaccguuucgcauuccaacuacccuucgccgagggcgccggagacggcgcgcgccuagauuucgucguccgauacgaaacccccgaggggaccuucugggcaaacaaucacggcagaaacuacaccgugcugcugaggaucgccccugccccgaccccuacugaugcugaaggccuuccacagcagcagcaguuaccccagcuggaaccacagccugaaugucaggggccuguggaggcugaggcucgccagcuuaaaucuuguaugaagccaguuaggaggcggccagccgaagaggagcuuaaaacaaaaaauauggaugacaacacguuugccauggcagaacacccagaugugcaggaaucugugggcccccuuguggcuccaaccccuuugagaccguggccucagaugacacugcaggucucugaugucccuaugaccggcaaccccgccgaagaaggagacguuccacgcagcucuccccccguggcauucacggaaguucugcaggcaccagccauccgcauccccccuucuucgccccuguguggucugggagggucaccaagggaucaggcuucugggccugaugcgagugagggagcuacaggaccguuccuggagccaucgcagcagcaagcagaggcuacuuggggugugagcuccgaaaacgguggaggucuagaggcuguuuccggaagcgaagaguugcugggagaggacacaaucgaccaggaguuggaacaacucuaccugagccaccugucuaggcugagagccgccguggcugccgguggggccggaggugguggcgaagggagcacagacggcgguaugucgcccagccauccacuggggauucugacagaucgcgaucuuaucuugaaauggccuggcccagaaagagcccugaacagugcccuugcagaggaaauuacacuccacuaugcacgguugggcaggggcguagagcugauuaaggacacggaagauccggaugaugagggagaaggcgaagaagguuuaucagugacuccauccagcccagagggcgacucccccaaagaaagcccccccgagauacugagcggcgcgcguucggugguugccaccaugggagaugucuggcugcccugggccgagggaagugggugugauggaccagugguguuaggaacagaaggucaguuuauuggcgauccagaaaaaggaaugggcaaggacaccucuagccugcauaugaacaggguuaucgccggggugacagagucccuuggcgaagccggaacugaggcucagauugaaguaacaagugaaugggcaggcucguuggaucccauaagcgggaaggagccugcgaguccugugcugcugcaaggucagaacccuacgcugcugagcccccugggcgcggaaguaugucuuucgucaguagcucggccucacguuagcucccaagacgagaaagaugcugggccuagcuuagagccuccuaagaagagccccacucuggcuguccccgcugagugcgucugcgcccugccuccgcagcuccggggacccuuaacucagacccucggaguuuuggcugggcuugugguggugccugucgcccugaacucaggcgugagucuuuuggugcuugcccugugucugucgcuugccugguuuagcuag

SEQ ID NO: 56091 - RNA, 1095 nt, Artificial Sequence
  Description of Artificial Sequence: Synthetic coding sequence
auggccgccaguggcccgggcuguagaagcuggugucuuugcccugaggucccaucugcaacauucuuuaccgcguuacugucccuguuggugagcggcccucgauuguuucuguuacagcagccccucgcuccuaguggacugacuuuaaagucagaggcauugagaaauuggcaaguauauaggcuagugaccuauauuuuuguguaugaaaacccuauaaguuugcugugcggcgcgauuaucauuuggagauucgcagggaauuuugagcguacagucggcacuguuagacauugcuuuuucacugucauuuuugccauuuucucagccauaaucuuucucuccuuugaagcugugucaucccugaguaaacuuggugaaguggaagacgcgcgcggauucacuccuguggcauuugcaaugcuaggggucacaaccgugaggagcagaaugcgucgagcccuggucuuuggaaugguggugccuuccgugcuggugccuuggcucuugcuuggagcuucuuggcugaucccucaaacauccuuucuaucaaauguuugcgggcucucuauagggcuggcauacggcuugacguauuguuacaguauugauuugagcgagcgggucgccuuaaaguuagaucagacuuuuccuuucucccugaugcgcaggaucucaguguuuaaguaugugagcgguuccagcgcugaaagacgcgccgcccaaaguaggaaauuaaacccugucccuggaaguuaucccacccaaaguugccauccucaucucucccccucccauccgguuucccaaacucagcacgcauccggccaaaagcuggcuucuuggccuucaugcaccccuggccacaugcccacccugccaccuuaucagcccgccucuggguuguguuauguccaaaaccacuuugggcccaauccaacuucuaguucaguguaccccgcgucagccggaacaucucuuggcauacagccccccacacccgugaacucaccaggcacugucuacagcggugcccugggcacaccuggcgcugcugggagcaaagagucuucccgggugccaaugcccuag

SEQ ID NO: 56092 - RNA, 2358 nt, Artificial Sequence
  Description of Artificial Sequence: Synthetic coding sequence
auguuggucgccggacuguugcucugggcaucacugcugacgggcgccuggccaucauuuccaacacaggaccaccugcccgcuacuccaagagucaggcugucauucaaagaguugaaggccacuggcaccgcucacuuuuucaacuuucuccugaauacgacugacuaucggauucucuuaaaggacgaggaucaugacagaauguaugugggaagcaaagacuauguucucuccuuggauuugcaugacaucaaccgagaaccccuuaucauccacugggccgccucuccacaacggaucgaggaauguguauugucugguaaggauguuaacggcgaaugcgggaacuucguucgguugauucagccuuggaaccguacgcaccuuuaugucugugggacgggcgcguauaaccccaugugcacuuacguaaaccgcgguaggagagcgcaggccacucccuggacacagacacaagccguucgcggucgaggcucuagagcaaccgacggggcccucagacccaugccgaccgcuccacgccaggauuauaucuucuaccuagagcccgagcgacucgaauccgguaaagggaaguguccauacgacccuaagcucgacaccgcuagcgcccucaucaacgaagaauuauacgcagggguguacaucgacuuuauggguaccgaugccgccauuuuccguacccuaggaaagcagacugccaugagaacugaccaguauaacucucgcuggcucaacgaccccaguuucauccacgccgaguuaauccccgauagugccgagaggaaugacgacaaauuauauuucuuuuuucgcgagcgguccgccgaggcaccccagucaccagcugucuacgcucgaauuggacguaucugucuaaaugaugaugguggacauuguugucucgugaacaaguggagcacauuucuaaaggcuagacuggugugcagcgugccaggugaagaugggauagagacacauuucgaugagcugcaggacguauuugugcaacagacccaggacguccguaauccggugaucuaugccguguuuacuucuucugguucuguguucagaggcuccgcugucugcgucuacagcauggccgacaucagaaugguguucaauggaccuuucgcgcauaaggagggaccaaacuaccaguggaugcccuucuccgggaaaaugcccuacccacggccaggcacauguccuggcgguacuuucacuccuagcaugaagucgacuaaggauuaccccgaugaagugauuaacuucaugcggagucacccucugauguaccaagcugucuacccacuccaacgcagacccuuagucguuaggacuggcgcgcccuauaggcucacaaccaucgccguggaccaggucgaugccgcagauggaagguaugagguccucuuucucgggaccgacagggggacgguucagaaggugauuguucugccaaaagaugaccaggagcuggaagaacuuaugcuugaagaaguugaaguuuucaaggaccccgcccccgugaaaacgaugaccaucagcaguaaacgccaacagcuguacgucgcaagugcuguugggguuacccaccugagucugcaucgaugucaggccuauggagccgcuugcgcagacuguugccuggccagggauccguauugugccugggaugggcaggcguguagccguuacaccgcaucuuccaaacgacgaucucgacggcaagacgugcgacaugguaacccaauacgccagugucggggauucaacaguaaugcuaauaaaaaugcaguugagucuguacaauauggaguggccggguccgcugccuucuuagaaugccagccacggaguccgcaggcgacagugaaauggcuguuccaacgcgacccaggcgaccgucggcgagaaaucagagccgaggaccgguuccuuagaacagaacaaggacuucuucugagggcccuccagcuauccgaucguggccuguauuccuguaccgccacagaaaauaauuucaaacacguggugacacggguucagcugcacgugcuagguagagaugcugugcaugcugcucuguuuccuccgcuauccaugagcgcuccucccccacccggagccggaccuccuacaccuccuuaccaggaacucgcccagcuucuagcacagccagaggugggcuugauccaccaguauugucagggauacuggcgacacguaccuccaucaccuagggaagcccccggggccccacgcuccccagagccacaggaucaaaagaaaccacgcaacagacggcaucauccaccugauaccuag

SEQ ID NO: 56093 - RNA, 1269 nt, Artificial Sequence
  Description of Artificial Sequence: Synthetic coding sequence
auggguaugacaagaauguuauuagaaugcucccuuagcgacaaguugugcguuauccaggagaaacaguaugaggucauaaucguucccacacuucuugugaccauuuuccucauccuucucggcgugauacucuggcuguuuauucgagaacaacggacccagcagcagcggucgggcccacagggcauugcgccaguuccucccccccgggaucugagcugggaagcugggcacggcggcaauguggcucugccgcucaaggagacaucaguggaaaauuuccugggugccaccacacccgcgcuggccaagcuacaaguucccagggagcagcuuuccgagguucuggaacagauauguucagguagcuguggccccaucuuuagggcuaauaugaauaccggugauccaucaaagccaaaguccgugauucugaaggcgcugaaagagccagccggacugcaugaggugcaggacuuucugggcaggauccaguuucaucaguaccucgguaaacacaaaaaccuuguccaacuggaaggaugcugcacggagaagcugccucuauacaugguccucgaagaugucgcccagggggaucugcuguccuuccuguggacgugucguagagacgucaugacaauggacggucugcuauaugaucugaccgagaagcagguuuaucacauaggcaaacagguacugcucgcccuggaauuucugcaggaaaagcaccuguuccacggugacgucgccgccagaaacauccugaugcaaucugacuugacagcgaagcuaugcgggcugggauuggcuuaugaaguuuacacacgcggcgccauuagcaguacacagacuaucccucugaaaugguuagcaccagaacgacuccugcugcgccccgcuagcauacgcgcugauguguggucauuugguauucugcuguacgaaaugguaacauugggcgcacccccauauccagaagucccccccacaagcauucucgagcauuugcagcggcgaaaaauuaugaagaggccuucaucuugcacgcauacaauguacaguaucaugaagagcuguuggcguuggcgggaagcggaucgcccaucuccucgggaacucagacucagacuggaggcggccauuaagacagcugaugacgaggcagugcuucaggugccagaacuuguagucccugaacucuacgccgcgguugcaggcauccgaguagaaucucuuuucuauaauuacucuaugcuguag

SEQ ID NO: 56094 - RNA, 1803 nt, Artificial Sequence
  Description of Artificial Sequence: Synthetic coding sequence
augagauccugucuauggcgaugucgucaucuaucucagggcgugcaguggagucuucuccuggccguuuugguuuucuuuuuguucgcgcuaccuagcuuuauuaaggagccacagaccaaacccagcagacaucagcguacagagaauauuaaggagcgaagucugcagagucuggcgaagccaaagucccaggcgcccacgagagcucggaggacaaccauuuacgcugagccaguuccagagaauaacgccuuaaacacccagacacagcccaaagcucacacaaccggugauagaggaaaggaagcuaaucaggccccgcccgaggagcaggacaaggugccccacacugcccaaagggccgccuggaaauccccugaaaaagagaaaaccaugguuaacacgcugucgcccagaggccaggaugcagguauggccucugggaggacggaggcgcaaaguuggaagagccaagacacgaagacuacucaggggaacggugggcagacccgaaagcugaccgcguccaggacaguuucagagaaacaccagggcaaggcggcuaccaccgcaaaaacacugauuccaaagagccaacaccggauguuggccccuaccggggcaguguccacucgaacacgccaaaagggggugacaacugcaguaauuccaccaaaagagaagaagccacaggccacaccuccucccgcucccuuucaauccccaacuacacagcgcaaccaaagguuaaaggcagccaauuuuaagagcgagcccaggugggacuucgaagaaaaguacagcuucgagaucggcggccuccagacuacuugcccugauucugugaaaaucaaagccucuaagucucucuggcuccagaaguuguucuuacccaaccugacucuauuccuggacucucgacacuuuaaccaaagugaaugggauaggcuggaacacuuugcucccccauuuggguucauggaauuaaauuauucacucgugcagaaaguagucacaagguucccaccagucccucagcagcagcuguuacuggccucacugcccgccggaucucuccgcuguaucacaugcgcagucgucggaaacggugggauccuaaacaacucccauaugggucaagaaaucgauagucacgacuauguauucagauugucuggcgcacuuaucaaagguuacgagcaggacguggguacucgcacuaguuuuuauggcuucaccgcauuuucucugacacaaucgcucuuaauccugggaaacagagguuuuaaaaauguccccuuggggaaagacguaagguaccugcacuuucuugagggaacccgcgacuacgagugguuagaagcuuuguugaugaaucagacugugauguccaaaaacuuauuuugguuccgacacagaccucaggaagcauuccgggaggcccugcauauggacagguacuugcuucuacauccugauuuucugagauauaugaaaaauagauucuugagguccaagacucuugauggugcccacuggcgcauuuauagaccgacaacaggugcccugcuccugcuaacugcuuuacagcuuugugaucaggucagcgcguacgguuucauaaccgaaggccacgaacgguuuuccgaccacuacuacgacacaucauggaagcgucugauauuuuauauuaaccacgauuuuaaacucgagcgagaagucuggaaacgguugcacgaugaaggcaucauucggcucuaucagcgcccuggacccgggacagccaaagcaaaaaacuag

SEQ ID NO: 56095 - RNA, 780 nt, Artificial Sequence
  Description of Artificial Sequence: Synthetic coding sequence
auggccccgaacaucuaucuaguccgacagagaauaucccgccugggucaacgaaugagcggcuuucagauuaaccucaacccccugaaagaaccuuuaggcuucaucaagguccuggaguggauugcuucaauuuuugccuucgccacaugcggagguuucaaaggacagacagagauucaaguaaauugcccgccagcaguuacugagaauaagaccgucacagcuaccuucggguacccuuuucgacuuaaugaagcaucauuucaaccacccccuggugucaacauaugcgauguuaauuggaaagacuacgucuuaaucggugacuauaguagcuccgcccaauuuuauguuaccuucgccgucuucguguuucucuacugcaucgccgcacucuuacuguacgugggguacaccucccuguaucuugacucucgcaagcugccaaugauugauuuuguuguuacauugguggccaccuuccuguggcucgugagcacgagcgcaugggcaaaagcccugacggacauaaagaucgcaacuggacacaacauuaucgaugagcucccuccuuguaagaaaaaagcagugcucuguuacuuugggucugugaccucaaugggcagucucaauguuucugugaucuuugguuuccugaauaugauucuuuggggaggcaacgcaugguuugucuacaaagaaacuucuuuacacuccccgagcaacaccucugccccgcacagccagggcggcauccccccaccuacaggcauuuag

SEQ ID NO: 56096 - RNA, 1299 nt, Artificial Sequence
  Description of Artificial Sequence: Synthetic coding sequence
auggacgaagcagugggggaccucaaacaagcucucccuuguguggccgaguccccuaccguccacguugaggugcaucagcggggcagcuccacagcuaagaaagaggauauuaaucucucaguuaggaaacuccucaacagacacaauaucgucuucggggauuacaccuggaccgaauuugacgaaccguuccuuacacgaaauguucaauccgugaguauuaucgacacagaacugaaagugaaggauucacaaccuaucgaccuguccgccuguacuguggcccugcauaucuuucagcuuaacgaagacgggcccagcucagagaaucuagaagaagagacagaaaacauuaucgccgccaaucacuggguguugcccgccgcugaguuccacggcuuaugggacaguuuaguauaugacguggaggugaagagccaccuccuggacuaugugaugaccacacuucuguucuccgauaaaaauguaaacuccaauuuaauuacuuggaacaggguggugcugcugcacgggccucccgguaccgguaaaaccucccuaugcaaagcucuggcacaaaaguuaacaauaagacuguccuccagguauagauauggccagcugauagaaaucaacucacacucucuguuuucaaaaugguuuucagaaucggguaaacuggugacgaaaauguuccagaaaauccaggacuuaauugaugauaaggaugcuuugguguucguccugauugacgaaguggaaagccugacggcggcacggaaugcauguagagccggcaccgaacccucagaugccauccggguggucaacgccguccugacucaaauugaccagauuaaaaggcacaguaacgugguaauuuugaccacuuccaauauuaccgaaaaaaucgauguggccuucgucgaucgagccgacauuaaacaguacauuggccccccaucugccgcagccauauuuaagauuuaccucuccugucucgaagagcugaugaaaugccagauuauauacccaaggcagcagcugcugacccucagagaacuugagaugauaggauucauugagaacaaugugucaaaguugagccuucuacucaaugacauuagccggaaaucagagggccuuaguggucgcgugcuacggaaacuccccuuccucgcucaugcacucuacguccaagcaccaaccgugaccaucgagggguucuugcaggccuugagucuggcagucgacaaacaguucgaggaacguaaaaagcuugccgcauauauauag

SEQ ID NO: 56097 - RNA, 522 nt, Artificial Sequence
  Description of Artificial Sequence: Synthetic coding sequence
auggcggauacuguguuauucgaauuucuccacacugaaaugguugccgaauugugggcucaugauccugauccaggcccugggguuagugcaggacuuagaggagaggaggcaggcgcuaccaaggggcagaagaugucacucucuguguuggagggaaugggauuucgcguaggccaggcacucggagaacgcuugccuagagagacacuugccuuuagggaagagcuggauguguugaaauuucuguguaaggaccuguggguggccguuuuccagaagcaaauggauagucugaggacuaaccaccagggaacauacguauugcaggauaacaguuuuccucuccuucuacccauggccucaggucuacaauaucuugaagaggcuccuaaauuccuggcauucacaugcggucuucugcggggugcacuuuauacccuggggaucgaauccguagugacggcuaguguagccgcacuccccguguguaaauuccaagucgugaucccgaagaguuag

SEQ ID NO: 56098 - RNA, 747 nt, Artificial Sequence
  Description of Artificial Sequence: Synthetic coding sequence
augaucuguaccuucuuaagggcugugcaguauacagagaaacugcauagguccucugccaaaaggcuucuacugccauauaucgucuugaacaaagccugccucaaaacggagcccagcuuacguugcggccuucaguaucaaaagaaaacgcuccgaccacguuguauccuaggagugacucagaaaacaauuuggacgcaaggcccgucuccacggaaggcaaaggaagaugguucuaaacaagugucugugcaucgcagucagaggggugguaccgcuguacccacuucgcagaaaguuaaggaggcugggcgagacuucacauaccuuauuguaguccuguuugguaucucaaucacgggcggacuuuucuauacaauuuuuaaggaacuuuucucuucaucaucgccuucuaagaucuaugggagagcguuagaaaaaugccggucccaucccgaaguaauuggugucuuuggggaaagcgucaagggauacggagaagugacuaggcgagggagacggcagcacgugagauuuaccgaguacguuaaggacggccugaagcauaccugcguuaaguucuauaucgagggaucagagccagggaaacagggaaccguuuacgcacaggugaaagaaaacccaggauccggcgaguacgacuuccgauacaucuucguggagaucgagucauauccccggcggacgauuaucaucgaagacaauagaagucaggaugauuag

SEQ ID NO: 56099 - RNA, 1257 nt, Artificial Sequence
  Description of Artificial Sequence: Synthetic coding sequence
auguaucggcccgcccgcguaacauccaccucgagguuccuaaacccguacguugucugcuucauuguggucgcaggcguggugauucucgcugugacuaucgcccuccuagucuacuuucucgccuucgaccaaaagucuuauuuuuacagaucaagcuuucagcuccugaauguggaguauaacagccaguugaauucuccugccacccaagaauaucgcacgcuaagugggagaauagaaagccugaucacuaagaccuucaaagagaguaaccuccgcaaccaauuuauccgagcucauguggcuaaauuacggcaagauggauccggcguccgggcagacguggugaugaaguuucaguucacacggaacaacaauggggcuuccaugaagucacgcaucgaauccguccugcgccagaugcugaauaauagcgggaaccuggaaaucaaucccuccacggagauaacaucuuuaacagaucaggcagcggcuaauuggcugauuaacgaguguggugccggaccagaucugauuacucuuagugaacagcgaaucuuggggggaacagaggcagaagagggauccuggccuuggcaaguaucguuacgguuaaauaacgcucaucauuguggcggaagccuuaucaacaauauguggauucugacugcagcacauuguuucagaaguaauucaaauccaagagauuggauugccacuaguggaauaucaacuaccuucccuaaacuccgcaugcgcguuaggaacauucuuauacacaacaacuauaaaucggcaacccacgaaaacgauauugcccucgugcgacuugaaaauucggugacuuuuaccaaagacauucauagcguuugucugcccgcugccacucagaacauucccccagguucgaccgccuacgucacaggcuggggugcccaagaauaugcuggucauacggucccggaacuacgacaggggcaggugagaauuaucucuaacgaugucuguaacgccccucauaguuauaauggggcgauucugucuggaauguuaugcgcaggcguuccacaaggcggaguggaugcuugccagggagacuccgguggacccuugguucaggaggauucccggagacugugguucaucgucgggauugugucauggggcgaucagugcgggcugccugacaagccaggaguguauacaagagugacugcauaccucgacuggauccggcagcagacaggaaucuag

SEQ ID NO: 56100 - RNA, 906 nt, Artificial Sequence
  Description of Artificial Sequence: Synthetic coding sequence
augaaguuccaauucacacguaauaauaauggcgccucaaugaagagucgcauugaguccguucugagacagaugcucaacaacucagggaaucuggaaauuaaucccucuaccgaaaucaccagccugaccgaucaggccgcagcaaacuggcucaucaacgaaugcggcgcaggaccagacuugauaaccuuaucugaacagagaauucugggcgggacagaggcugaggagggcaguuggccuuggcaggugagccugagacuaaauaaugcgcaucauugcggcgguucccuaauuaauaauauguggauauuaacggcagcucacugcuucagaucaaacaguaauccaagggacuggaucgccacauccgguauuuccacaacauuucccaaauuacggaugcgggugcgcaacauucugauucauaacaauuauaaguccgcaacucacgagaacgauaucgccuuggugcgacucgagaauuccguuaccuuuacuaaggacauucacuccgugugcuuacccgcagcuacucagaauauaccuccaggauccacagcauacgugacuggcuggggagcacaggaauaugccggacacacaguucccgaauugaggcagggacaagugagaauuaucucuaacgauguuugcaacgccccacauuccuacaauggcgcuauccucucagguaugcucugugcuggcguaccgcaaggagguguggacgccugucaaggagauagcggcgggccacuuguccaagaagauuccagacgccugugguuuauugugggaauuguaagcuggggggaucaaugcggccucccagacaaacccggcguguacaccagggugaccgccuauuuagacuggauccgucagcagacgggcaucuag

SEQ ID NO: 56101 - RNA, 1440 nt, Artificial Sequence
  Description of Artificial Sequence: Synthetic coding sequence
auggccgucuuaggggugcagcuggucgugacauuacugacagcgacgcugaugcaucgccuggccccacacuguaguuuugcccgauggcuauuguguaauggcagccucuucagauacaagcacccuuccgaagaagagcucagggcccuggcaggaaagccgcggccacgcggccggaaagaaaggugggccaacgguuuguccgaggaaaaaccccugagcguucccagagacgcccccuuccagcucgaaaccugcccucuuaccaccguugacgcucuggugcucagauucuuucucgaauaucagugguucguugacuuugcuguguauagcggcggaguguaccuguucacagaggcuuacuacuauaugcugggaccagccaaagaaacuaauaucgcuguguucuggugccucuugacaguaaccuucucaaucaagauguuccugaccguuaccagacuauauuuuucagcugaggaaggaggcgagcgaucugugugccuaacuuuugcuuucuuguucuuacuccuggcuaugcugguccaggugguucgugaagaaacccuggagcugggacuggaacccggccuugcguccaugacccagaacuuggaaccccugcuuaaaaaacagggaugggacugggcacucccuguagccaaacuggcuaucagagucggccuagcagugguggguuccgugcucggcgccuucuugacauucccugguuugagacuggcccagacacacagagacgcccugaccaugagcgaagauagaccuaugcugcaguuccuguugcauaccagcuuucuuuccccgcucuucauucuguggcuguggaccaaaccaauagcacgugauuuccugcaucaaccgccauuuggggaaaccagguucucucucuuaucugacucugccuuugauagcggucgacuauggcugcuggugguacuuugccuauuaagacuugcaguaacgcgcccccaucuacaggcuuaccugugcuuggccaaagcuaggguggaacaauugaggagagaggcuggacggaucgaagcaagggaaauacagcagagggucgugcgcgucuauugcuaugugaccguuguuagccuccaguaucugacaccucuuauccugaccuuaaauuguacccuucuacugaaaacacugggcggcuacucguggggacugggcccagccccucucuugucacccgaucccucuucagcguccgccgcccccaucggaucuggugaggacgagguccaacaaacugcugcucgaauugccggugcucugggggggcugcuuacgccccuguuucuccgcggcguccucgcuuaccuuauuugguggacagccgcaugucagcucuuggcuagccucuucggccucuauuuucaucagcacuuggcuggcagcuag

SEQ ID NO: 56102 - RNA, 708 nt, Artificial Sequence
  Description of Artificial Sequence: Synthetic coding sequence
augggaacugcagacuccgacgaaauggcaccagaggcgccccagcacacccacaucgacgugcauauccaucaggaauccgccuuggcuaagcuccuacuaacauguuguuccgcacuuagaccucgcgcuacucaagcccgcggcucaagucggcugcugguugcuuccugggugaugcaaaucguuuuagguauuuuauccgcgguccuaggaggauuuuuuuauauucgggacuauacucugcucguuaccagcggcgccgcgauauggacuggugcaguggccguacucgcaggcgcggccgcuuuuaucuacgaaaagagggguggcacauacugggcucuccugaggacacugcucacccuggcagcuuucuccacggcgaucgcagccuuaaagcuuuggaaugaggauuuccgcuauggguauuccuauuauaauucggccugccgcauuaguaguucuucugauuggaauaccccugcccccacucaauccccagaagaggucagacgcuugcaucuguguacaaguuuuauggacauguuaaaagcacuguuccggaccuuacaggcuaugcuccuuggaguuuggauccuacuccuccucgcaucacugacaccauuguggcucuacuguuggcggauguuuccaacaaaaggcaaaagagaucagaaggaaaugcuggaggucagcgggaucuag

SEQ ID NO: 56103 - RNA, 8487 nt, Artificial Sequence
  Description of Artificial Sequence: Synthetic coding sequence
augccuaagcgggcccauuggggagcauuauccguggugcugauacuucuuuggggucauccccggguagcucuggcuugcccccauccgugugccugcuacgugcccagcgaaguccacuguacuuuuagaucccuggccagcguccccgcagggauagcaaaacacguggagcgcaucaaccugggauuuaauucuauccaagccuuguccgaaacguccuuugcuggucucaccaaacuugaacuucuaaugauccacgggaaugagaucccuagcauuccagacggugcccucagggacuuauccucauuacaaguauucaaguuuucuuauaacaagcucagggucauuacugggcagacccugcagggccuuucaaaccuuaugagacuccauaucgaccauaacaagauugaauucauccacccgcaagcguuuaauggccugacuagucuuaggcugcuucaucucgaagggaaucuucuccaccagcuucacccgucaaccuuuucuaccuucacuuuccuggauuacuuccgccuuagcaccauccgacauuuauaccuggcggagaacauggugcgaacucugcccgcaagcaugcuccgcaacaugccacuguuagagaaucuguaucugcaggguaacccuuggacaugugacugcgagaugagaugguuccuugagugggaugccaagucccgcgguauucucaaauguaaaaaagacaaggcauacgagggugggcaacuuugcgccaugugcuuuaguccaaagaagcucuacaagcacgaaauccauaagcuaaaagacaugacaugucugaagccaagcaucgagucgccucuuaggcaaaauagaaguaggagcauagaggaggagcaggagcaggaggaagaugggggcagccaauugaucuuagaaaaauuccaauuaccucaguggagcaucucauuaaacaugacugaugaacacgggaacauggugaacuuggugugcgacauuaaaaaaccuauggauguuuacaagauucaccugaaccagacugauccucccgauaucgacaucaacgcaacgguagcgcuugacuucgaaugucccaugacaagagaaaacuacgagaaguuauggaagcucauagcuuauuacucagaagucccaguaaaacugcauagagaacugauguugagcaaggacccaagagugaguuaccaguacaggcaagacgccgacgaagaggcuuuauacuauacaggagugcgggcccagauccucgcagagccggagugggugaugcagccaagcauugacauacaacuaaaucgacggcaauccacagcuaagaaaguucuguuaagcuacuacacacaguacucccaaacaauuuccaccaaagauacaagacaggcuagaggccgcucuugggucaugauugaaccaagcggcgcgguccagcgagaccagacuguacuagagggcggcccaugucaacuguccuguaaugugaaagccucugagucccccagcaucuucugggugcugcccgacggcucuauuuuaaaagcccccauggacgaucccgacagcaaguuuucaauccuuucaucaggauggcuuaggaucaaguccauggaaccuucugauagcggccuguaccaaugcauagcccaggugcgagacgaaauggauaggaugguguaucgcguccuggugcagucuccaucuacucagccugccgagaaggacaccgugacuaucggaaaaaacccuggggagucaguaacccugccaugcaacgcgcuugccaucccagaggcccaucuguccuggaucuuaccgaacagacgaauuauaaacgaccuggccaacaccagucacguguacaugcuuccuaauggcacacucuccauacccaaaguccagguuagugauagcgguuacuaucgauguguggccguaaaccaacaaggggcagaccacuucaccguuggcauaacagugacuaaaaaagguagcggccugccuucuaaacgcggucggagaccuggagcaaaagcccuuagucgggugagagaagauaucgucgaggacgagggcggcuccggaaugggggacgaagaaaacacuuccaggagauuauugcacccuaaggaucaagagguguuucugaaaaccaaggacgacgcaaucaacggcgacaagaaagcuaaaaagggaagacggaagcuuaaguuguggaaacacucugaaaaggagccugaaacuaacguggcagaggggcgccgaguuuuugagucuagaaggcgcauaaauauggcuaauaagcagaucaaccccgagcgaugggccgacauccucgcuaagguacgcgggaaaaaccugcccaaaggcaccgaagucccuccucugaucaagaccacaagcccacccucccuuagucuugaagugacaccaccguuucccgccauuucgcccccauccgcuagcccuguccagacgguuacuuccgccgaggagagcagcgcugacgucccguuguugggggaagaggagcauguacugggaaccauuagcagugcuucuaugggacuugagcacaaucacaauggggugauucucgucgaacccgaggugaccagcacgccccuggaggaggugguggacgaccugucugagaaaaccgaagaaauuacuucaacugaaggugauuugaaagguaccgccgcuccaacacugaucagcgaacccuacgaaccuucgccuacacuccauacacuggacacuguauaugaaaagccaacacacgaagaaacugccacggaaggguggagcgccgcagaugucggcucuucucccgagccuaccaguuccgaauaugaaccaccauuagaugccgucucccuggcagaguccgaaccaaugcaauauuuugaccccgaucuugagacuaagagucagccagaugaggacaagaugaaggaagacacguucgcccauuuaacacccacucccacaaucugggugaacgacucgagcacuagccagcuauucgaggacucaacuaucggcgagccuggagucccugggcagagccaucugcaggggcugacggauaauauucaccucgugaaauccagccugucaacacaggauacccuccuuauuaaaaaagguaugaaggagaugucucagacacugcaggguggcaacaugcuggagggggacccuacccacucucgcucguccgagagcgaaggccaggagucaaagucaauuacacugcccgauagcacccuggguaucauguccucgaugucuccugugaagaaacccgcugagacuaccguuggaacccuucucgacaaagauacuaccacagcaacuacgacgccgagacagaagguggcuccauccagcacaaugaguacccaccccucccgccggagaccaaauggccguaggcgccuaagaccaaauaaauuuaggcaucgucauaagcagaccccaccuacaacuuuugccccaagcgagaccuuuaguacccaaccuacucaggcgccugacaucaaaaucagcagccagguugagucuagccucguaccaacagccuggguggacaacaccguuaacacuccaaaacagcucgaaauggagaaaaacgcggaacccacaucaaaggguacaccaagaaggaagcaugggaaaagaccaaacaagcaucgcuauacccccuccacagucaguucucgugcaucuggcuccaagccaucccccucgccugagaauaaacaccgcaacauagugacaccuagcucugaaacgauccuacugccacgaaccgugaguuuaaaaacugaaggucccuacgacucccuugacuauaugacuacaaccagaaagauuuauaguucuuauccuaaggugcaggagacacuacccgugacguacaagccuacuagugauggcaaggagaucaaagaugacguggcaaccaacguggauaagcacaagucugacauucuggugacgggugagaguauuacuaaugcuauuccgaccucgcggagccuugucaguacuaugggcgaauucaaggaagagucgucccccgugggcuuucccggaaccccuacauggaaucccucuagaacagcccagccuggccggcugcagaccgggauuccgguuaccacauccggugaaaaccucaccgauccuccccugcucaaggagcucgaggauguggacuuuacuagugaauuucuguccucccugacaguauccacuccuuuccaucaggaggaagccggcucuucgaccacccuuucaucuauuaaaguggaaguagccucuagccaggccgagaccacaacacuggaucaggaccaccuggagacaaccgucgccauucuucugagcgaaacccguccucagaaccauaccccaaccgccgccaggaugaaggaacccgccucuaguucuccguccacaauacucaugucacugggucagaccacgaccaccaaacccgcacugccaucaccuaggauaagccaggcaucucgcgauagcaaagagaaugucuucuugaauuacguggggaaucccgagacugaggcuacacccguaaacaacgagggcacucagcacaugucaggcccuaaugagcucucuacuccuucaagcgaccaagacgccuucaaucugagcacaaaguuggagcuugagaaacaggucuuuggguccagaagccucccccgcggcccagacucucagcggcaggacggucgagugcaugcaagucaucagcucacccgggugccugcuaaaccuauccugcccaccgccaccgugcgcuuaccggaaaugagcacucagagcgcuucacgguauuucgugacuucccagucaccccgccauuggacgaauaagcccgaaauuacaaccuaccccucuggagcccuucccgagaauaagcaguuuacuaccccccgucugucuucuacaacaaucccucucccacuucacaugagcaagcccagcaucccgucuaaguuuacagaucggagaacggaucaauuuaacggcuacucaaagguguucgguaacaacaacauacccgaggccagaaacccagugggaaaaccucccaguccucggaucccacacuacagcaaugggagacugccuuucuucacgaauaagacauugaguuuuccucagcucggagucacccgacgcccacagauucccaccagcccagccccaguaaugcgugaacggaaggucaucccaggaagcuacaacaggauccacucgcacagcaccuuccaccucgacuuuggcccaccagccccaccauuacugcauacaccccaaacuacagguucuccaagcacuaaucuccagaacauaccuaugguuucuucuacgcaaaguucuauuucuuuuauaacaucuuccgugcaguccucaggaucguuccaucagucuuccaguaaguuuuucgcgggaggccccccagccuccaaguucuggucucuuggugagaaaccacaaauacucacuaaaucaccacagacaguuucuguuaccgccgaaacugacacuguuuuucccugcgaagcaacugggaagccaaagccuuucgucaccuggacgaaggucucuaccggugcucuuaugacaccuaauaccaggauucagcgguucgagguuuugaagaaugguacacuugugauaaggaaggugcaggugcaagaccgcgggcaguacaugugcacggccucaaauuugcacggucuggaccggauggucguccugcuguccguaacagugcagcagccacagauccuggccucucauuaucaggacgucacagucuaucuuggugacacgauugccauggaaugcuuggcuaagggaacaccagcaccucaaaucaguuggauuuucccggauagaagaguguggcagacgguaagcccugucgaaggacgaaucaccuuacaugagaaccgcacacuaaguaucaaggaagcgucauuuagugaccgcggcguuuauaaguguguugccagcaaugccgcuggagccgauagucuugcgauacgucugcauguagcggcuuugcccccugucauacaucaggagaaacuggagaacauuagucugccgcccggucucuccauacauauccauugcaccgcuaaggccgccccccucccuagcgucaggugggugcucggggauggcacacagaucagacccagccaguuccuacacggcaaucuguucguguucccaaacggcacacuguacaucagaaaccuagccccaaaggauucgggccgcuaugaguguguggcugccaauuuggucgggucugcgagacgcaccguucagcugaacgugcaacgggcggcugcgaaugcacggauuacugguaccagcccccggagaacugacgugcgguauggcggaaccuugaaacuggauugcucggccucaggagacccuuggccacggauccuguggagacucccuucuaagcggaugauagaugcccuguuuucauuugacuccaggaucaaaguguucgcuaacggcacucuuguggugaagucugugacagacaaggacgccggggacuaccugugugucgcacgaaacaaggugggagacgauuacgucguacucaaaguggaugucguuaugaaacccgcuaagaucgagcauaaagaggagaacgaccacaaggucuuuuacggcggggaucugaaaguugauugcguugcuaccgggcugccgaacccagaaauuucuuggucacuaccagauggaucucuggugaauuccuucaugcaaagcgaugacagugguggucgcaccaaacguuacgucguuuuuaacaacgggacccuauacuucaacgaagugggaaugcgagaggagggggacuauacauguuuugccgaaaaucaagugggcaaagacgaaaugagaguucgcgugaaaguugugacagcucccgcaacuauccggaacaagaccuaucuagccguccaggugccuuacggagaugucguuacagucgcaugugaggccaagggcgaaccuaugccaaaggugacuuggcucucgccgacgaacaaggugaucccaaccagcagugagaaauaucagaucuaccaagacggcacacugcugauccagaaagcccagcgcuccgacucugggaacuacaccugccugguccggaauagugcgggcgaagacagaaaaacggucuggauucaugugaacgugcagcccccgaaaauuaacggcaaccccaacccuauuacaacagugagagagauugccgcgggugggucucguaaacugauugacuguaaggcugaaggaauuccuacaccccgaguuuugugggccuucccggaagguguaguguugcccgccccuuacuauggcaaucggaucaccgugcauggcaacgguucacuugacauaagaagucugaggaagagugacucagugcaacuggugugcauggcuagaaaugaaggaggagaggcacguuugauccugcagcugaccgugcuugaaccuauggagaagccaauauuccacgacccaauuagcgagaagauuacagcaauggccgggcacacgauuagucucaauuguuccgccgccgguacgccaacaccuagucuuguauggguacucccuaacgggacagaccuacagucuggucaacagcuacagcgcuuuuaccauaaggccgaugggaugcuucauaucaguggccuaucauccgucgaugcaggagcuuaucggugcgucgcucgcaaugcugcaggacauaccgaacggcugguuagcuugaagguuggacuuaaaccagaagcaaacaaacaguaucauaaccuggugaguauuauuaacggcgaaacauuaaaacugccaugcacgccaccaggcgcaggacagggcagguuuucuuggacgcucccgaacgggaugcaccuggaaggaccgcagacacucggccgcgugagccugcucgacaacgguacccucacagugagagaagcaucuguguuugauagagggacauacguauguagaauggagaccgaguacggcccaucagugacauccauacccguuauugugauugcuuacccaccuagaauuacauccgaacccacaccaguuauuuacacgcggccaggcaacacagugaaacugaacuguauggccauggggauccccaaggcugauaucacgugggagcugcccgacaagucgcauuuaaaggcgggcguucaggcucgguuguaugggaaucgauuucuucacccucaaggaagccugaccauccagcaugcaacacagagggaugccggcuucuacaaguguauggccaaaaauauucuggggucugacucuaaaaccacuuauauucacguuuuuuag

SEQ ID NO: 56104 - RNA, 921 nt, Artificial Sequence
  Description of Artificial Sequence: Synthetic coding sequence
auggcugcaguggacgauuugcaauuugaggaguucggaaaugcugccacgucccuaacagcaaauccugaugccacaacugucaauauugaggacccaggugagaccccuaaacaccagccgggaucuccuagagggagcgguagagaagaggaugaugagcugcuggguaacgacgacagugacaaaaccgaacuuuuggccggccagaagaaguccucccccuucuggaccuucgaguacuaccagacuuucuuugacgucgacacauaucagguuuucgauaggauaaaaggaucccuucuaccaauucccgggaagaauuuuguuagauuguauauucgguccaaucccgaucucuacggaccauucuggaucugugccacccuuguuuucgcuauagccauaaguggcaaucuuagcaauuucuuaauccaucuaggugagaaaacguaucacuaugugccugaauuccgcaaagugucuaucgccgccaccaucauauacgcauacgcuuggcugguaccgcucgcucuguggggguuccucauguggcgcaacaguaaagucaugaauauugugagcuacagcuuucuugaaaucgugugcguguauggguauucccuguuuauauauaucccuaccgcgauuuuguggaucauuccccagaaagcagugcgauggauccuggugaugaucgcccuggggaucucugggucucuuuuagcaaugacauuuuggccagcgguucgggaagacaauaggcgcguggcuuuggccacgauugugaccaucguucuguugcacaugcuuuugucuguuggaugucuagcuuacuucuucgacgcaccugaaauggaucaucuaccuacgacuacagcuacgccaaaccagaccguggccgcugcuaaaaguucauag

SEQ ID NO: 56105 - RNA, 1881 nt, Artificial Sequence
  Description of Artificial Sequence: Synthetic coding sequence
augguugcuccauggagagucagcgugcgcgucugccuaucacaucuuagaugcuuugagcugcgccaaggacugagccugcucagacccuccgaauguccuagggacgcucgccuguguuggcugcuguuaggcacucuuccaaagguggucuccuuguguggugaugugggagaaggugcuccggaugugcugucccgaagaagagugcgguguagcggagccgcuggggcuggacccgccgagagcuuaccacgugcugggccauuaggagggguuuuccuccaccugagauuguggcuaagagcaggcgcgcugcuggucaaauucuuuccucuccugcuccucuacccacucaccuacuuggcacccuccgucaguacauuauggcuacaucuucuucugaaagcuaccgaaaccaguggcccaacauacaucaagcucggacagugggcuaguacuagacgcgauuuguucagugaggcuuucugugcacaguuuaguaaacuucauguuagagucacgccgcacccuuggacacacacugaaagauucuugcggcaagccuuuggugaugacugggguucuaucuugucuuucgagaaucgcgagcccgugggaaguggauguguggcccagguuuacaaagccuacgcaaacaccgcuuuucuggagacugacagcgugcagagacuuggaagggccuccuguuuaccccccuucucacauacaggcgcugucggaggguugagggagcucuuuggcuaucucgguaacggaagaaaaccgcccgaaaaucucgcugaucaguccuuucuugagaggcuccuccucccgaaagcagaccucguuggcuccaacgccggcguaucccgagcucagguccccggccaucagccugaagcuacuaaucugaucuccguagcuguuaagguucugcacccaggccuccucgcucagguucauauggaucuuuugcugaugaaaauugguucccgggucuuaggaguucugccaggaaucaagugguugucccugcccgaaauuguggaagaauucgagaaauugauggugcaacagaucgauuuaagauacgaggcccagaaucuggagcauuuccaggucaauuucagaaacguaaaggccguuaaguucccgaccccacuccgcccuuucguuacacgggagguuuuggucgagaccuacgaagaaagcgucccugugucuucuuaccaacaggccggaauucccguggaucuuaaaaggaagauagcaagacucgguauuaauaugcugcugaaaaugaucuucgucgauaacuucgugcacgcagacuuacaccccggcaauauuuuagugcagggcgccaacggguuguccucuagccaagaagcccaguuacaacaggcagauaucugugacacccugguaguggccguccccagcucgcugugcccucuccgccucguguuguuagaugccgguauugucgccgaguugcaggcucccgacuugcggaauuuuagggcuguuuucauggccgucgugaugggucaagggcagagaguggcugaacuuauucuucaucaugcuagggcauccgaaugccgagacguggaaggcuucaagacugagauggcaaugcugguaacacaggcucgcaaaaacacaauuacucuggagaaacugcacguuaguucccuucugucaucuguguuuaaacugcuuaugacucauaaggugaaauuggaaucgaacuucgccuccaucguguuugccauuaugguacuugagggacucggccgcucccucgauccgaaacuugacauccuggaagccgcccgucccuuccucuugaccggccccguuuguccacccuag

SEQ ID NO: 56106 - RNA, 3699 nt, Artificial Sequence
  Description of Artificial Sequence: Synthetic coding sequence
auggcagaggcagcaaguggcgccgguggaaccucacucgagggagaacgcgguaagagaccaccaccggagggcgagcccgccgcuccagcaucuggggugcuugauaaguuauuuggaaagcgacuacuccaggcaggaagguaucugguaagucacaaagccuggaugaaaacagugccaacugagaacugugacguucugaugaccuucccagacacaacugacgaucacacccuuuugugguuacugaaucauauuagagucgggaucccugaacugauugugcaagugaggcaucauagacacaccagagcuuaugcuuuuuuugugacggcuacuuaugagucacugcuacgaggcgcagaugagcuuggcuugagaaaggccgucaaggccgaguucgguggagggacuagaggauuuucaugcgaggaagacuucauuuaugagaauguugaaucugaguugcgauuuuucaccucacaggaacgacagagcaucauaagauuuuggcugcaaaaccuccgcgcaaagcagggggaggcacuccacaaugugagguuucuagaagaccagccaauaauacccgaguuagcagcucgcgguauaauucagcagguguucccagugcaugaacaaagaauccugaaccgccucaugaaaaguuggguccaggccguuugcgaaaaccagccucuggaugacauuugcgacuacuuugguguaaagaucgcaauguacuucgcuuggcuuggcuucuacacaagugccaugguguauccugcaguuuuuggcucugugcucuacaccuucaccgaagccgaccagaccagccgggaugugagcugcguggucuucgcccucuucaauguaauauggucuacacuguuucucgaagaauggaaaagacgaggagccgaacucgccuauaagugggggacauuggacucuccaggcgaggcagucgaagagccccguccacaauucagggggguacggcgcauuuccccaaucacuagagccgaagaauuuuacuacccaccguggaagcgccuccuauuccagcuguuggucucucugccacuuugucuagcguguuugguguguguuuuccuucuaaugcucggguguuuucaguuacaggaauuggugcucucuguuaagggucugccuagauuagcccgauuucuccccaaagugaugcucgcccugcuggugucagugagugcugagggguacaagaaacuggcuauauggcucaaugacauggaaaacuauagacucgaaucugcauaugaaaaacaccugauuaucaaggucguguuguuucaauuugugaauagcuacuugagucuguucuacaucggauuuuaucuuaaggacauggaacgauugaaggaaauguuagcaacccuucugauaaccaggcaguuccuccaaaaugugcgagaagugcuucaaccacacuuguauagaaggcugggucgaggagaacucggcuugagggcaguaugggaacuggcacgagcgcugcuugguuuguuaucgcugagacgcccggcaccgcgcagacucgagccgcaggcggaugaagguggugguggcggguccggaggcgggggaaggcggugcuuauccgguggguguggggcuccugaggaggaggaagaggcugcacuuguggagcggagaagagcaggcgagggcggggaggaaggagacgguccgccaggagggaaagaagaagacgaggacgacgaggaggaggaggacgaggaagaggaggaggacgaagaggagggagaagaagguggucugcuggacugcgggcuucgacuaaagaaaguaaguuuugcugagagaggcgcgggaaggcgacgaccgggaccuaguccugaggcgcuccuggaggagggcucaccaacuaugguggaaaagggccuggagccuggagucuuuacacucgcagaggaagaugacgaagcugaaggagcgccuggcagccccgagcgcgagccuccagccauacuguuuaggagagcugggggagagggccgagaccaaggacccgacggcgggccagauccagaaccgggaucuaauuccgacuccacccgccggcagcgcagacagaauagguccuccuggauugacccaccugaagaggagcacucuccacaguugacacaggcugagcuggaaucuuguaugaagaaguaugaagauacauuccaagacuaucaggaaauguucgugcaauuuggauaugucguuuuauucucuagcgccuucccccuagccgcacuuugugcacucguuaauaaucugauagaaaucagauccgacgccuuuaagcugugcaccggacuucagagaccauucggccagcgugucgagucuaucgggcaguggcaaaaagucauggaggcaaugggcguucuggcaaucguugugaacugcuaucugauaggucaguguggacaguugcagagacuuuuuccuuggcugucacccgaggcugccauugugagcgucguuguguuagaacauuuugcccuccuacugaaguaccuuauacacguggccauuccugacauucccggcugggucgccgaagagauggcuaaauuggaauaccagagacgagaagccuuuaaaagacaugagcgccaggcacaacaucgauaccaacagcagcagcgacgaagaagggaagaggaagagcgacagcgccacgcugaacaucacgccaggcgggaacacgacuccggaggacgcgaagaggccagagcagagggaagcggccuugaucccgcuacuucuuccgaaaaggcaucugcaaaagcuaaaggaucuaccgcaggagggcacgguccagagagacccaagagaccaggaucccuacuagcuccuaauaaugugaugaaacuuaaacagauaaucccacuccagggaaaauuuuuaucuuccggcgcuacauccaguuuggcggcggccggcgccggcgcaacgacuagacccccuccugcacagucuccuaccggcuccgacacacgccucccugcuuucuugucuuucaaguuccugaaguccccugaaacucguagggauucugaacgcagccauucuccaccuaaagcauuucacgcuggcaaguuguucccauuuggagggacccgcgccgaaccaggcaguaacggggcaggcggucaagcgaggccagacggcacucccaguucuggcucuagcaggguccaacgcucuggaccuguggacgaagcccuggcagaagaacucgaagcaccccggccagaggaggaagguucgggcacggcuuuagcucccgucggcgccccagcucucaggaccagacgcuccagaucaccugcaccgccccccccaaugcccuugcccagaccgccuaccccccccgcuggaugcuggcagugggauggcccuugggggugcggaggagagggagccgcuccaagacaagcccuagcagcagcagaaugcccgccuugugcuauggcugguccccccccugcaccucaaccccuaccgggggacgcuucguucuauucucuaccacccccuccucucccucccacauccgacccacuugaaaccccugcaccuucucccuccccuuccccguccccucaagccgugugcuggccauccggauggcauuag

SEQ ID NO: 56107 - RNA, 726 nt, Artificial Sequence
  Description of Artificial Sequence: Synthetic coding sequence
augacccugcagugggcugccguugccacauuucuuuacgccgaaaucgggcugauucucauuuucugucugccauucauccccccgcagcgcuggcagaagauauucucguucaacguauggggcaaaauagcaaccuuuuggaacaaagcuuuccucacaaucaucauccucuugauaguucuuuuccuugacgcagucagggaagucagaaaguacagcagcgugcacacuaucgaaaaaagcucuaccucaagacccgacgcuuaugaacacacccaaaugaaacucuucagaucacagaggaacuuauauaucucaggauucucccucuuuuuuugguuggugcuucgcagacuagugacccucauaacucagcuagcuaaggaacucucgaauaaaggugugcuuaaaacccaggcugaaaacacuaacaaagcggcaaagaaguuuauggaagagaaugagaagcugaagagaauacugaaaagccauggaaaagaugaggaaugcguguuggaggcggagaauaagaaacuuguggaggaccaggaaaaauugaaaacugaacugcgcaaaacauccgacgcacucaguaaggcccaaaaugaugugauggaaaugaagaugcaaagcgagagguuaagcaaggaauaugaccagcuauuaaaagagcacuccgaacuucaggaccgccuagagagagggaauaaaaaaagacuguag

SEQ ID NO: 56108 - RNA, 1431 nt, Artificial Sequence
  Description of Artificial Sequence: Synthetic coding sequence
augggccgaaaggaagaggaugauugcaguucauggaagaaacagaccaccaacauuagaaaaaccuucaucuuuauggagguucugggaucuggagcauuuucagagguauuuuuagucaaacagagacuuacggggaaguuauuugcucugaaaugcauuaaaaaaaguccagccuuccgagauucaucccuugagaaugagaucgcaguucugaagaaaauuaaacaugaaaauauuguaacccuagaagauauuuaugagagcaccacacacuauuaucuggugaugcaguuggucucugggggggaacucuuugaucgcauacucgagcgaggaguuuauacggaaaaggacgccucacuggugauucaacaagucuugucagcagucaaauaccuccacgagaacgguaucguccaccgcgaccugaaaccagagaaucugcuuuaccugaccccagaagagaauagcaaaauaaugaucacggacuuuggacucagcaaaauggaacagaacggcauuaugucgacugcaugcgguacgcccggguacguggcgccugaaguuuuggcacagaaacccuacucgaaagcuguugauuguugguccaucggcgucaucacguacauacucuuaugcggcuaccccccauuuuacgaagagacagaaaguaaguuauucgagaagaucaaggagggcuauuacgaguuugagagcccauucugggacgacaucucugagagcgcaaaggauuuuauuugucacuuacuagaaaaggauccuaacgaacgcuacacgugcgaaaaggccuugucacacccuuggauugacgggaauacugcucuccaccgggacauuuaccccaguguguccuuacagauucagaaaaauuuugcuaaaaguaaauggaggcaggcuuuuaacgcugcugccgucgugcaccauaugcgcaaacuacauaugaaccuucacucaccaggcguccggccugagguggagaaccgaccacccgagacccaagcaagcgaaacaucucggccguccagcccugagauuaccauuaccgaagcuccugucuuagaccacuccguugcacugccagcacucacacaacucccaugccaacacggccgacgaccaaccgcacccgggggacgcucuuuaaauugccuagucaauggaucucugcacauuucuuccagccuuguuccaaugcaucaaggcucacucgcugcuggcccaugcggcuguuguuccuccugucucaauauuggaucaaaaggcaaaucuuccuauuguucugaaccaaccuuauugaagaaggcaaacaagaagcagaauuuuaagagcgaagucaugguuccaguuaaagcaagugguagcucacacugucgagcgggucaaacaggagugugccuaaucauguag

SEQ ID NO: 56109 - RNA, 3750 nt, Artificial Sequence
  Description of Artificial Sequence: Synthetic coding sequence
augguagaggccgcaccaccuggacccgggccucuacgccgcaccuuccuuguacccgaaaucaaauccuuggaccaguaugacuucagcagagcuaaagcagcagcuucccucgcaugggugcucagagccgcauuuggaggcgcagagcacgucccucccgagcuuugggagccuuuuuacacagaucaguaugcgcaggaacacguaaagccgcccgucacccgccugcuucugucugcugagcuguacuguagggccuggcgacaagcucugccccagcuugaaacuccuccgaaucccucugcccugcuggcccuccucgcacgccguggaacagucccugcacuuccggaaagacccguuagggaggcugaccuaagacaucaaccgauucuaaugggagcacaccucgcugugauugacgcucucauggccgccuuugcuuucgaguggacaaagacccuaccggguccccuggcccuuacgagucucgagcacaaguugcuuuucuggguggauacgacuguccgacgacuccaggagaaaaccgaacaagaggcugcccaacgcgcuagcccugcugcacccgcugauggugccgcgccugcucagccuuccauucgcuacagaaaagauagagucguggcucgacgggcaccuugcuuuccaacuguuaccucccuucaggacuuggccucgggcgccgcacuugcugccacuauccacuguuauugcccucagcugcucaggcuugaagaagugugccucaaggacccuaugagcgucgccgacagcuuguauaaccuccagcuaguucaggacuucugugccucacgacugccuagaggcuguccccugucccucgaggaucugcuuuacgugccuccccccuugaaggugaaccuggucguaaugcuggccgaacucuuuauguguuuugaggucuuaaagcccgacuuuguccagguuaaagaucugccugacggucacgccgcaagcccacgaggcaccgaagcuagucccccccaaaacaacaguggguccaguagcccagucuucacauuccggcacccucuccuuaguuccggcggcccccagagcccccuccggggcucuaccggaagucucaagucaucaccgaguaugagucacauggaagcuuuaggcaaagccuggaaucgacagcucaguagaccccuuucucaggcagugucauuuaguacacccuuuggccuugacagugauguggacguugugaugggagauccagugcuguugcgcucugucaguucagauucucucggcccuccccgccccgcccccgcaagaaccccuacccagccuccccccgaaccaggagaucugcccaccauugaggaagcccuccaaauaauccauucugcagaaccgcggcugcucccggauggcgcagcagacggcuccuuuuaucugcauuccccagagggaccaucaaagcccucgcuugccucuccauaucuaccugaaggcacaaguaagccacugucugauaggccuaccaaagcaccuguauauaugccccauccugagacacccagcaaaccuagccccugucuagugggcgaagcgagcaaaccucccgccccaagcgaaggauccccaaaagccguggcuuccaguccugccgccacuaacagugaggucaaaaugacuuccuuugcugaacgaaaaaagcagcuagucaaagccgaagccgaggcuggagcuggcaguccuacuucuacuccugcccccccagaggcguuaagcagugaaaugucagagcucuccgcacgauuagaggagaaacgacgcgcaaucgaggcucagaagcgaaggauugaggcuauauucgccaagcauagacagagacuuggcaagagugccuuucuccaagugcaaccacgagaagccuccggugaggcagaagcagaagccgaagaggcggauaguggccccguuccuggaggcgagagaccagccggcgagggccagggcgaaccaacaagucgcccuaaggccgugacguuuuccccagaucugggccccgugccgcaugaagguuuaggagaauauaaccgggcugucucaaagcuuagcgcagcacuguccucccuacagcgugauaugcaacggcugacagaccaacagcagaggcuauuggcccccccggaggccccuggguccgcaccacccccggcagccugggugauuccaggccccaccaccggcccaaaggccgcaagcccuucaccugcccgaagaguccccgcaacucgacgcucccccggaccaggcccuucucagucuccccgaucccccaagcacacacgcccagccgaacuuagacucgccccucucacucgagucuuaaccccaccccaugacguugauucccugccucacuugcgcaaauuuagcccuucccaaguacccguucagacgagguccucuauacuguuggcugaggaaaccccgcccgaagaaccagccgcacguccaggucuuauugagauccccuuggggucccucgcagauccagcugcagaggacgaaggcgacgggagccccgccggcgcggaagauagcuuggaagaggaagcaagcagcgagggcgagccaagagugggacuaggguuuuucuauaaggacgaagacaaaccagaggaugaaauggcccaaaaaagggcuucacuccuagaaaggcagcagcggagggccgaggaggcuagaagaaggaaacaauggcaggagguggagaaagaacaaagaagagaggaagcugcuagauuggcccaggaagaagccccuggacccgccccauuggugucagcagugccuauggccacaccugcgccagcagcccgcgcaccggccgaggaggaaguggggcccaggaaaggagauuuuacucgacaggaauaugagcgacgcgcccaguuaaaacuaauggaugaucuggacaagguucugcgaccuagagcagcuggcuccgguggaccagggagaggcggacgccgggcuacaagaccgcgcuccggaugcugugacgauuccgcgcucgcucguagcccagccagaggccuccucggauccaggcuuagcaagauuuacucccaaucuacccugucccucucuacuguggccaaugaagcacacaauaaucuuggggucaaaaggccaaccagccgagcccccaguccuagcggccugaugucacccucacgcuugccaggaagccgggagcgugacugggagaauggaagcaaugccuccagucccgccagugucccagaguauacuggaccucgcuuguacaaagaaccuuccgcuaaguccaacaaguuuaucauacauaaugccuuaucacauugcugccuagccggaaaagucaaugagccacagaaaaacagaauacuugaagaaauugaaaaaagcaaggcgaaccauuuucucaucuuauuucgggacucgucaugucaauucagagcccuuuauacgcucaguggagagaccgaggagcugagcagguuggcuggcuauggaccucgaacugucaccccagcaaugguugaaggcauuuauaaauauaauagcgaccgcaaacgguucacucaaauaccggccaaaacgaugagcaugucugucgacgccuuuacgauucaaggacaucuauggcaaggaaaaaagccuacuacaccaaaaaaggggggaggaacgccuaaguag

SEQ ID NO: 56110 - RNA, 798 nt, Artificial Sequence
  Description of Artificial Sequence: Synthetic coding sequence
augggcucaccauccgcuugcccauacagaguuuguauacccuggcaaggacuguugcuaacagccucucuuuugaccuuuuggaaccuaccuaacagcgcccagacuaauauagauguuguccccuuuaauguagcggaagggaaggagguuuugcugguggugcacaaugagagccagaacuuguacggguauaacugguauaaaggggagagaguccacgcgaauuacaggauaauaggauaugucaagaauaucucacaagagaaugccccgggaccugcucacaauggccgcgagacuauuuaccccaacgggacccuccuuauccagaacgugacucauaacgacgcuggcuucuauacuuuacaugucauuaaggaaaaccuugugaaugaagaggugaccaggcaauuuuauguguucucagaaccuccuaagccaaguaucacuuccaauaauuuuaauccgguggagaauaaagacauugucgugcuaacuugccagccugaaacgcagaacaccacauaccuauggugggucaacaaccagagccuccuugugagcccccgacuauuacugagcacagacaacaggaccuugguuuuacugagcgcaacaaaaaaugauauaggcccauacgagugugaaauccagaaucccgucggugccuccagaagcgauccagugacacuuaacguuagauacgagucagugcaggccuccuccccggaucucagcgcagguacugcugucuccaucaugauuggaguccucgcugguauggccuuaaucuag

SEQ ID NO: 56111 - RNA, 1182 nt, Artificial Sequence
  Description of Artificial Sequence: Synthetic coding sequence
auguaugccugguuuuuccucccguccuucagucagucccccccuacauuuggauuucugcucgauauugauggaguguugguacguggccacagagugauacccgcugcucuuaaagcauuucggcgccucgugaacucacagggucaacuccgagugcccguaguguucgucacaaaugccggcaauauccuccaacacucaaaagcucaggaguuaagugcucuguuggguugugaaguugaugcugaucaagucauacucagucacucuccuaugaagcuuuuuuccgaguaccaugaaaagagaaugcuagugaguggacaagggcccguuauggaaaacgcgcaggggcugggguuuaggaacguggugaccguagacgaauugcggauggcuuucccucucuuggauaugguggaccuagaaagacgccugaaaacuacacccuugccacggaacgacuuccccagaauugagggcguucugcugcuuggagaacccguuaggugggagaccucacuacagcuuaucauggaugugcuucucaguaacggcaguccuggcgcagggcuggccacaccccccuacccccauuugccuguccuugcaucaaauauggaccuacucuggauggcggaggcuaaaaugccacgguucggacacggcaccuuuuugcucugucucgaaaccaucuaccaaaaggugacagguaaggagcucagauacgaaggccuuaugggcaaaccuaguauccuaacuuaccaguacgcugaagaucugauucgccgacaggcugaaagacgaggaugggcagcacccauuagaaagcucuacgcggucggagauaaucccaugucagacguguauggcgccaaccucuuucaucaauaccugcaaaaagcaacucacgauggugcccccgagcucggcgccggaggaacuagacagcagcaaccgucugccucucaaucuuguauuucuauucuagugugcacugguguuuauaacccccgcaacccucaaucaacugagccgguucugggcggaggcgagccccccuuccacggacaucgcgaucuaugcuuuucuccaggguuaauggaagcuucucacguggucaaugacgucaacgaagccguucagcuugucuucagaaaagaaggcugggcccucgaauag

SEQ ID NO: 56112 - RNA, 1326 nt, Artificial Sequence
  Description of Artificial Sequence: Synthetic coding sequence
augagugugcugcuuaggaguggccuugguccacugugugccguugcacgcgcugccauaccguuuauuuggaggggcaaauacuuuucuucagggaacgaaccagccgaaaaccccguuaccccaauguuaaggcaucucauguauaaaauuaaaucuacagggccgaucacgguggccgaguauaugaaagagguucugacgaauccugcaaaaggauacuacguguacagagauaugcuuggagagaaaggcgauuuuauaaccuccccugaaauuucccagaucuucggcgagcuauuaggaaucugguuuauuagcgaauggauggccaccgggaagagcacugccuuccaacuggucgaacuugguccggggcggggaacucuggugggagacaucuugaggguguucacacaacucggcagcguuuugaagaacugugacauaagcgugcaccugguagaggugucacagaaauugagugagauucaagcacugacacuaacaaaggagaaagugccucuugagcgcaacgcaggaagucccguguacaugaagggcgugacuaagaguggaaucccaauuucuugguauagagauuugcaugacguaccuaagggguauagcuuuuaucuggcacaugaguucuuugaugucuugcccguucauaaauuccaaaaaacaccacaaggcuggcgggaggucuucgucgauaucgauccccagguuucagacaaauugcgguucguuuuggcacccucagccaccccugcugaagcguucauucaacacgacgagacacgagaucacguugaaguuugccccgacgccggcgugauuauagaggagcugucccaacgcauagcuuuaacaggcggugccgcacuaguugccgacuauggacaugacgggaccaaaacggacaccuuucgaggcuucugugaccauaagcugcacgacguccugaucgcccccgggaccgccgaucuaaccgcggacguggauuuuaguuaucuuagaagaauggcucaggggaaaguggcuucucugggacccauuaaacagcauacauuccugaaaaauaugggcauugacgugagauuaaaagucuugcucgacaaaucuaaugaaccuucagugcgacagcagcuccugcagggguacgauaugcugaugaacccaaagaagaugggagaacguuucaacuuuuuugcucuccugccacaucaacgacuacagggagggagauaucaaaggaaugcccgacagucuaaacccuuugccucuguugucgccggcuuuuccgaauuagcuuggcaauag

SEQ ID NO: 56113 - RNA, 1539 nt, Artificial Sequence
  Description of Artificial Sequence: Synthetic coding sequence
augcuuuucgaaggccuggaccucguuucugcacuagccacccuugcagcuugccucguaagugugacucuccuguuagcugucagucagcagcuauggcaguugcgaugggcugcgacccgggacaagagcuguaaauuaccuauuccaaaggguucuaugggguucccacugauaggggaaaccggacauuggcugcugcaaggauccggauuucagaguucaagacgugagaaguauggaaauguuuucaagacacaccugcuuggacggccacuaaucaggguuacgggagccgagaaugugcgcaaaaucuugaugggagaacaucaccuuguuucaacagaguggccaaggucuacuagaaugcuucugggcccuaacacugugagcaauagcaucggggauauucacaggaauaaacguaagguguuuuccaaaauuuuuagucaugaagcccuugaguccuaccuuccgaagauucaacuaguuauccaagauacccuucgcgcuuggucaucacacccagaggccaucaacguuuaccaagaggcucaaaagcucacguuuaggauggccauuagaguccuccucggguuuagcauucccgaggaggaucucggccaccuguuugagguguaucaacaguucguagacaacgucuuuucacuaccaguggaccuaccauuuagcgguuacaggaggggaauccaagcacggcaaauuuugcagaagggucucgaaaaagcgauucgggaaaaacugcaguguacacaagggaaagauuaccucgaugccuuagaucugcucauugaauccagcaaggagcacggaaaagaaaugacaaugcaggagcugaaagaugguacccuagagcuuaucuucgcugcguacgccacgacugccagugcuuccacguccuugaucaugcaacuccugaagcacccaacuguucuggaaaaauuacgggaugaacugcgggcgcacggaauccugcauucuggugguugcccaugcgaggggacccuacgcuuggauaccuuguccggcuugcgcuaccuggacuguguaauuaaagaggugaugagacuguuuaccccuauaucgggaggguaucggaccguguugcaaaccuuugaacuggacggauuucaaaucccaaaaggauggagcguuauguauagcaucagagacacucaugacaccgcaccagucuucaaagacgugaauguauuugaucccgacagguuuucacaggcaagauccgaggacaaagauggcagguuccauuauuugcccuucggcggcggcgugcggacuugucuuggaaaacaucucgcaaagcucuuucugaagguccuugcaguugagcuagcuuccacuagccgguuugaauuggcuacgagaacauucccaaggaucacacucgugcccgugcuccacccuguggacggccuuagcguaaaauucuucggacucgacuccaaccaaaaugaaauucucccagaaaccgaagccauguuaagugcaacaguguag

SEQ ID NO: 56114 - RNA, 573 nt, Artificial Sequence
  Description of Artificial Sequence: Synthetic coding sequence
augcucaccccugcauuccacuuuaacauccucaagcccuauaugaaaaucuuuaaugaauccgucaacauuaugcacgcgaaauggcagcuacuggcuagugaaggcuccgcuugucuggauauguuugaacacauaucacuuaugacccucgauagucuucagaaaugcguguucucauucgacucacauugucaggagaagccuucagaauacaucgccgccaucuuagagcuuagcgcucucgucagcaagcgucaccaugaaauucuucugcauaucgacuuccuuuacuaccucacacccgacggccaaagauuuagaagagcuugcaggcuggugcacgauuuuacugaugcugucauccaggaacggagacgcacucugccaucucaggggguugacgacuuucuacaggcuaaagccaaaucaaagacguuggauuuuauagacgugcuccuacuaagcaaagccaugaccccccggcccgugguuaguccagguuccugcaccacccuccaguccacacaaaauaccagaucugccgccgguagacggugcaaaaacuuuuag

SEQ ID NO: 56115 - RNA, 720 nt, Artificial Sequence
  Description of Artificial Sequence: Synthetic coding sequence
auggccuaccagucucuccgcuuggaauaccugcagaucccucccguuucacgagcauacaccaccgccugcguccucaccacugccgccguccaacuggaauugaucaccccauuucagcucuauuuuaacccugagcuaauuuuuaagcacuuccagauauggagacuaauuacuaacuuuuuguucuucggaccuguuggcuucaauuuucuuuuuaacaugauuuuccuauaucgguacugccguaugcuagaggaagguaguuuucgcgggcguaccgccgauuuuguauuuauguuccuuuuugggggcuuccuuaugacauuguuuggacuguuuguguccuuaguauuucucggacaggcguuuaccauaaugcuuguguaugucuggucccgucgcaaccccuacgucagaaugaacuucuuuggauugcugaauuuucaggccccauuucuuccuuggguacucaugggauuuagucugcucuugggcaauagcaucaucguugaccuucuaggaaucgccguuggacauauuuacuuuuuuuuggaagacguuuuucccaaccagcccgggggcaucagaauacugaaaacgccaucuauucugaaggcaauuuuugauacaccagacgaggauccaaauuauaacccguugccugaagagagacccggaggguucgccuggggagagggacagcggcuuggaggcuag

SEQ ID NO: 56116 - RNA, 2211 nt, Artificial Sequence
  Description of Artificial Sequence: Synthetic coding sequence
auggccgggaguucuacuggcggaggaggcgugggcgagacuaaagugaucuaccaucuggaugaagaggaaacaccauauuuaguuaaaauuccugugcccgccgagaggaucacccuaggugauuucaagagcguguugcaacgcccagcuggggcaaaauacuuuuucaagucuauggaccaggacuuuggcguggugaaggaggagaucuccgaugauaaugcacgucuacccuguuuuaauggacgggugguaagcuggcugguuagcagcgauaauccacaaccugaaauggcuccaccagugcacgaaccacgagcugaacuagcacccccugccccuccccucccuccauuaccacccgaaagaacguccggcaucggcgacucuaggccaccguccuuccauccaaacguaucuucuucacacgaaaaccuggagccugagacagaaacagaguccgugguuucucugcggcgcgaacgaccgaggaggagagauucuagugagcauggagcuggagggcacagaacgggcggccccuccagacuggaaaggcaucuggccgguuacgaaucuucaucaacacugaugaccagcgagcuggaaucuaccucccuaggcgauagcgaugaagaggacaccaugagucgguucucuagcucuacugaacagucuucagccucucgucuacucaagcggcauaggagacgcaggaaacagcgacccccaagacucgagagaacaucuuccuucaguagcguaacagauaguacaaugagccuuaacauuaucacggucacucuuaacauggagaaauauaacuuuuuaggcauuagcauugucgggcagucuaacgagcggggagacgggggcaucuauauaggcaguauuaugaaggggggagccguggcagcagacgggcggauagaaccuggggacaugcuguuacagguuaaugauaugaauuucgagaacauguccaaugaugacgccguucgggugcuccgagacauagugcacaaaccuggaccuaucguccuuaccguggcaaaauguugggacccaagcccacaggcuuauuucacuuuaccaaggaaugaacccauccagccuauagacccugcagcuugggugucucacagcgcugcacucaccggcacauuucccgcuuauccuggaucgucuaguaugucaacaaucacguccggaucuucauugcccgauggcugugagggacguggauuauccgugcauaccgauauggccucuguuacuaaggccauggccgcuccugaauccggguuggaaguaagggaccguauguggcucaaaaucacgauaccuaacgccuuuuuaggcuccgauguaguggacuggcuuuaucaccacguggaaggguucccugaacgaagggaggcgagaaaguacgcuucaggguugcugaaagcuggauuaauaagacauaccgugaacaaaaucaccuucucugagcaguguuacuauguguuuggcgaccugucaggcggaugugagagcuaccuugugaaccuuucgcucaacgacaacgacggaagcuccggcgcaucagaucaggauacccucgcuccccuucccggcgcaaccccauggccgcuucugccuacauuuucauaucaauacccugccccacaccccuauucgccucagccuccccccuaccacgagcucucuuccuacaccuauggcggagggucagcaucuagccagcacuccgaaggcaguaggaguaguggcuccacccgcucagacggcggugccggucgcacgggcagaccugaagagcgggcuccagaguccaagagcgggucaggaagcgaaucagaaccuucaucgagggggggcucgcucagacgggguggagaggcuaguggcacaucagacggcggucccccgccauccagaggcucaaccggaggagcacccaaucuacgagcgcacccgggcuuacauccuuauggacccccacccggaauggcgcugccuuacaacccuaugaugguugucaugaugccccccccccccccgcccguacccccugccguucaaccuccaggcgccccucccguucgggaccucggaagugugccgccagagcuaaccgcaaguagacaguccuuucauauggcuaugggcaaccccucagaauucuucguggacguuauguag

SEQ ID NO: 56117 - RNA, 462 nt, Artificial Sequence
  Description of Artificial Sequence: Synthetic coding sequence
auguccgaaauucaagguacaguggaguuuagcguggaguugcauaaguucuauaauguugauuuguuucagagggguuacuaucaaauaaggguuacccugaagguauccagucgcauaccucaucgccugagcgcaaguauugcagggcaaaccgagucaagcagccugcauuccgcuugcgugcaugauagcacuguucauaguagaguguuucagaucuuguaucgcaaugaggaagugccaaucaacgaugcagucguauucagaguccaccucuugcucggcggggagcgcauggaagacgcucugucugaaguggauuuccaguugaagguggaccugcauuucaccgauagcgaacagcaguuaagagacguagccggcgcucccaugguuucuucccgcacucucggucuccacuuccacccucgcaauggccuccaucaucaaguacccuag

SEQ ID NO: 56118 - RNA, 1074 nt, Artificial Sequence
  Description of Artificial Sequence: Synthetic coding sequence
auggcaacaacugugccugacgggugccgaaacggauugaagagcaaauacuaccggcugugugauaaggcugaagcuuggggaaucgugcucgaaacaguggcaacugcuggagucguaacaucaguggcauuuaugcugacccuaccaauacuuguuugcaaaguacaggacuccaaucgacgcaaaaugcuuccgacgcaguuccuguuccuccucggcguucuuggcaucuuuggacuuaccuucgcauuuauuaucggacuugauggcaguacuggcccuaccagguucuuccuguuugguauacucuucucaauuuguuuuucuugcuuacuggcacaugcugucuccuugaccaaguuaguucggggucggaagcccuuaucacuccuggugauucucggucuugcagucggguuuucucucguccaggacguuaucgccauagaguacauuguccucacuaugaaucgcacgaacguuaacguuuucuccgagcucagcgcccccaggcguaaugaagauuucguccuucuuuuaacuuaugugcuauuccuaauggcacucacauuucuuaugagcucuuucacuuuuugugggucauucacaggcuggaaaagacacggggcccauaucuacuugacgaugcuguugagcauugcuaucuggguugcuuggaucacucugcucaugcucccugacuucgaucggcgcugggacgauaccauucugucuuccgcccuggccgcgaauggauggguguuccuguuggcauaugucucuccugaauucuggcuuuugacuaaacagaggaaccccauggauuauccuguggaggacgcuuucuguaaaccgcaacuggucaaaaagucauacggcguggaaaaucgugccuacucccaggaagagauuacccagggcuuugaagagacaggcgacacguuauacgcuccuuacucgacucacuuccagcugcagaaccagccuccacaaaaagaauuuaguauuccucgugcacacgccuggccaucccccuauaaggauuaugagguuaaaaaggaaggcaguuag

SEQ ID NO: 56119 - RNA, 1149 nt, Artificial Sequence
  Description of Artificial Sequence: Synthetic coding sequence
augagauccggcggcagaggcagaccacgccuccgauuaggagagagaggccuaauggagccccuacuacccccaaagagaagguugcugccucgcgugcgguugcugccccucuuacuggcuuuggcagucggaucagcuuuuuauaccaucuggagcggcuggcacagaaggacggaggaacugccacucgggagagaacugagagugccucuuauugguucauuaccggaagcccgucuacgcagggucgucggacagcuggacccucaacgccuguggaguacauaucugagaccucugcucguaguucggaccccgggaaguccaggaaaucugcagguuaggaaguuccuugaggcuacgcuccgcucccuuacugcuggcuggcacgucgagcuggaccccuucaccgcaagcacaccucuuggccccguggacuucggcaaugugguggcaacacuagacccgcgggcugcacgccacuugacucucgcuugucacuacgacaguaagcuuuuuccucccggaucaaccccguucgugggcgcuaccgacucagcaguuccuugugcacuucuucuggaacucgcccaagcuuuagaucuggaacucucgcgcgcgaaaaaacaggccgcccccgucacccuacagcuguuguuccuugacggcgaggaagcucugaaagaauggggccccaaagauucacuguacggaucaagacacuuggcacaacugauggagaguaucccgcauuccccuggcccuacaagaauccaggccaucgaacucuuuaugcuguuggacuuacucggugcaccgaauccuacuuuuuacucgcacuucccacguaccgugcggugguuccacagacugaggucaaucgagaagcggcuccacaggcucaaccucuuacagucccacccgcaggaggucauguauuuucagcccggugaaccuuucgguagcguggaagacgaccauaucccuuuucugagacgaggaguucccguccugcaucuuauuuccacccccuucccagccguauggcacacgccagcagauaccgagguuaauuugcauccuccaacagugcauaaccucuguagaauacucgccguuuuucuagcagaguaucucggcuuguag

SEQ ID NO: 56120 - RNA, 924 nt, Artificial Sequence
  Description of Artificial Sequence: Synthetic coding sequence
auggcagcucuucugcuuggagccguccuccuggucgcucagccccagcugguaccgagucgaccagccgaguugggacagcaggaacugcuuagaaaggccgguacuuugcaagaugacguucgugacggaguagcgccgaacggaagugcucaacaguuaccacaaacuaucauaauuggcgugagaaaaggugggacaagagcucugcuggaaauguuaucucuucauccugacgucgccgccgcugaaaacgaaguucacuucuucgauugggaagaacacuacagccacggccuggguugguaccugucacagaugccauuuucauggccacaccaacucacaguggagaaaacucccgcguauuuuaccagcccaaaaguuccagaacgcguuuacucgaugaauccuagcauaagauuguugcugauucuacgugauccuucugaacgcguccugagugacuacacacaaguauuuuacaaucacaugcagaaacacaaaccuuauccuagcaucgaagaauuucuuguuagagacggacggcuaaacgucgacuauaaggcauuaaacagaucauuguaccauguacauaugcagaauugguuacgcuucuuccccuugagacauauucauauagucgauggagaccgccuaaucagggauccuuuccccgaaauucaaaaagucgagagauuucugaagcugagcccacaaaucaacgccuccaacuucuauuucaacaaaacaaagggauuuuauugucuucgcgauucugggcgagaccguugucugcacgaaucuaagggaagggcacauccccagguggauccuaaauuacuaaacaagcugcacgaauacuuccacgaaccaaauaaaaaauucuuugaguuaguuggacggacuuuugauuggcauuag

SEQ ID NO: 56121 - RNA, 975 nt, Artificial Sequence
  Description of Artificial Sequence: Synthetic coding sequence
augcuccucggcgaacucggagucuuugcaucauacgccuuugccccacuuagccugauagugccccucucagcagugagcgucaucgccagcgcgauaaucggcaucauauuuauuaaagagaaguggaaacccaaggacuuccugcggcgcuacguacuauccuucguugguugcggacuggcugucgugggaaccuacuuguuaguuacauucgccccaaacucacaugagaaaaugacuggugagaacgugacgcgccaccugguaagcuggcccuuccugcuguacauguugguagaaauuauccuauuuugucuuuuauuauauuucuacaaagaaaaaaaugccaacaauauugucguuauccuguugcuuguagcacuccuggguucgaugaccguggugacaguuaaagcuguugccggcaugcucguucugucaauacagggcaauuugcagcucgauuaucccauuuucuacgugauguuuguuugcaugguggcaaccgcagucuaccaggcugccuuccugucucaggcaucccaaauguacgacucuucccuuaucgccuccguuggauauauacugaguacuacgaucgcuauuacugcuggagcaauuuucuacuuggacuucaucggggaagauguccuucauauuugcauguucgcccuuggcugucucaucgccuuccuagggguguucuugauaaccagaaauagaaagaagcccaucccauuugaacccuacaucuccauggaugcaaugccuggaaugcagaacaugcacgauaaaggcaugacaguccagccugaguuaaaagccuccuucucuuauggcgcgcuggaaaacaacgacaacaucucugaaaucuaugcgccugcuacucugccaguuaugcaagaagagcauggguccagaucagcuuccggcgucccuuauaggguccucgaacacaccaaaaaggaauag

SEQ ID NO: 56122 - RNA, 2283 nt, Artificial Sequence
  Description of Artificial Sequence: Synthetic coding sequence
augguccugaaagccuuuuucccaacgugcugcgucagcacugauagcgguuugcucgucgguagaugggugccugagcaauccucagcaguugugcuugcagucuugcacuuccccuucauacccauccaagugaaacaacuccuugcucaggucagacaggccucacagguagguguagcugugcuggguacuuggugucacugcagacaggaacccgaggagagucuggguagauucuuggaaucacugggagcuguauucccccacgagccauggcugcgcuugugccgugaacggggcggaacauucuggagcugcgaagccacacaccgccaggccccuaccgcaccaggagccccaggagaggaccaggugauguuaauauucuacgaccaacgacaggugcuuuugucucagcuccacuugccuacagugcuacccgacaggcaagccggggcuacuaccgcaucuacaggaggacuagccgccguguucgauaccguagcgcgguccgaaguauuauuccgcucagaccgauucgacgaaggcccagucagacuaagccauuggcagucugaaggcguugaggccucuauucuugcagaguuagcaagaagagcuucuggaccgauaugucugcuccucgcuucucuucucagcuuaguuucggcagucucagccugcagagucuuuaaauuauggccucuuaguuucuuagggagcaagcuguccacuugcgagcaacugaggcacagacuugaacaccugacucuuaucuuuagcacacggaaggcugaaaacccggcccagcugaugcgcaaagcuaauacugucgcuagcguccucuuggacgucgcccugggucuuaugcuguugagcuggcuccacggccgaucacgcauugggcaccuagcagaugcacuuguaccaguugccgaccacgucgcugaagaguugcagcaucuccugcaguggcugaugggagcuccugcggggcugaaaaugaauagggcacucgaucaggugcuggguagguuuuucuuguaccacauacaccuuuggauaaguuacauccaccuuaugucccccuuugucgaacacauucuguggcaugugggucucucugccugucuuggacuuaccguggcucugucccugcucuccgauauuaucgcacuccuuacguuccacauuuauuguuuuuacguuuacggcgcaagauuguauugccuuaaaauacauggucucucaucucucuggagguuguucaggggcaaaaaguggaauguccugcgacagaggguggacuccugcagcuaugaucuggaucaacuguucaucggcacacuuuuauucacaauauuacucuuucuauugccaaccacggccuuauacuauuugguuuuuacgcuucugcgccuccugguugucgccgugcagggacugauacaccuuuugguggaccucauaaacagcuuacccuuguauucccucggacugagacucugccgcccauauagacuggcagauaaacccacugcacugcagccacgcggcgcucaucugcccccaccgcaacugugguugcccccucaagcucuccuuggaagacccguaccucaagccgugccuuggggcgcucaccugccgcuagaggcagagcguggccaggccggacuucgcgaacugcuggcgcgccuggccccuccucacggccacagucaacccuccgcccuccccgguuggcaccaauuguccuggcggaugucuugugcccuguggacacuccugugcgcuccagaacacgggagacccuguuaccauacgcuuggccuugaaguaaucggaagcgaacagauguggggauggccggcucgauuggcugcgcugcaccauuggcacugccugcccugggacccacugccaacuuguugcggccaucacggaggcgaacacucuaauccacgcugcccugaacauugccccaugccgacacuaugcacacagguccagaggguuagacccccccagcagccccagguugaggguuggagucccuggggucuuccuagcggcucagcacuggccguaggaguggaagggcccugucaggacgaaccuccuucaccuagacaccccuuagcuccuuccgcagaacaacacccagcuagcggaggcuuaaagcaaucccucacccccgugccuuccgggccaggacccucucuaccagagccccauggcgucuaccuccgcauguuuccaggcgaagucgcauuguag

SEQ ID NO: 56123 - RNA, 2400 nt, Artificial Sequence
  Description of Artificial Sequence: Synthetic coding sequence
auggcccgaaccgccccugucgagcccccacugcggcauucugcaccuccaucuccugccgcaggcgagccgaggacuuccguggaggccgcuguugcaccccgaagagugcuuuuugcugaugaagcguugggacugcccuuagcgcaacuacgacgguauagacccuggggcggacccggagcuggaaaaauggccgcagccgcaggccaggaugggggggguggaggaggggcggacgaggacgacgauggcgaggauggcgaugaaggagaagaggaggaagaagcuuguccugagcccucuccccuauguccuguaccugcuggugggggcuucuaccugguuccuacguuuucucucccacccgcccccggaagacucgagaggcucggcagagugaugguugaauuagaagcgcuguuaccuccuccaggagccgugcccggcggugcaggcguuuggguccccgggggacggccgccaguguuacgcggucuuguaagaguacugaaccgaucauuugagaaagccguucaugugcgggcaucccacgacggcugggcauccuuuugugaucaccccgcacgcuauguaccccguucaccacccugggccggagccggagguacaggcgccggggauccuauucucgaccccggacugggucuuggaccaggucaagcaagcgccagcucaccugaugacgggggccgcaccgaccgguuugcuuuucaguugcccuuugcugagggggcaggggacggugcccgacuagacuucguggugagguaugaaacuccagaggggacauucugggcaaauaaucacggccgaaauuauacagugcuucuaagaaucgcucccgcucccacuccuacggacgcggagggccugccucagcagcaacaauuaccucaguuggagccacagccagagugccagggacccguugaagcagaggcuagacagcuaaaguccugcaugaaaccgguccgacgacgaccagccgaagaggaauuaaagaccaaaaacauggaugauaauaccuucgcuauggccgaacacccggauguucaggaaucuguugggccucucgucgcuccuacaccccuaagaccuuggccacagaugacacuacagguaucagacguuccaaugaccggaaaccccgcagaagagggggauguuccccgaucuucucccccgguggcauucaccgaaguguugcaggcaccagcaauuagaauaccuccgaguucaccccugugugggcuuggcggauccccgcgggaccaggcaucaggacccgacgcuucagaaggugcaacaggacccuuucuggaaccaucccagcaacaggcugaggcgaccuggggagugucuagcgaaaacggcggaggauuggaggccgugagugguucagaggaguugcuaggugaggacacaauagaccaggaguuagaacaacuguaccucucucacuugucccgucugcgggccgccguggcugccgguggggccggaggugguggcgaagggagcacagacggcgguaugucgcccagccauccacuggggauucugacagaucgcgaucuuaucuugaaauggccuggcccagaaagagcccugaacagugcccuugcagaggaaauuacacuccacuaugcacgguugggcaggggcguagagcugauuaaggacacggaagauccggaugaugagggagaaggcgaagaagguuuaucagugacuccauccagcccagagggcgacucccccaaagaaagcccccccgaaauccuuuccggagcuagaucugugguggcaacaaugggggauguuuggcuucccugggcggaaggcagcggaugugaugggccugugguccuggguacugaggggcaguucaucggggauccugaaaaaggcauggggaaagacacuucuagccugcacaugaaccgaguuaucgccggagugacagaaucucucggggaggcagggacagaggcacaaauagaaguaaccagcgagugggccgguucucuggauccaaucuccggaaaagagccugccuccccaguccuauugcagggucagaauccaacucuuuugaguccguuaggagccgaaguuugccuaucgucaguggcccgcccacaugugucaucccaggaugagaaagacgccgggccaagccuggaacccccuaaaaaaagccccacacuugcuguucccgccgaauguguuugugcccucccgccgcagcuucgaggaccucuuacccagaccuuggggguucuggcagguuugguugucgucccuguugcucugaauuccggggucucccuccuugugcucgcgcugugccugucucucgcaugguucucuuag

SEQ ID NO: 56124 - RNA, 1095 nt, Artificial Sequence
  Description of Artificial Sequence: Synthetic coding sequence
auggccgccaguggcccgggcuguagaagcuggugucuuugcccugaggucccaucugcaacauucuuuaccgcguuacugucccuguuggugagcggcccucgauuguuucuguuacagcagccccucgcuccuaguggacugacuuuaaagucagaggcauugagaaauuggcaaguauauaggcuagugaccuauauuuuuguguaugaaaacccuauaaguuugcugugcggcgcgauuaucauuuggagauucgcagggaauuuugagcguacagucggcacuguuagacauugcuuuuucaccgugauauucgcuaucuucucugcaauaauuuuucucucuuucgaggccguuucaagccuaucuaaacugggggagguugaggacgcacgaggguucaccccugucgcuuucgcaauguugggggucacaacuguuagaucuaggaugcgcagagcgcucguauucggaaugguggugcccagcgugcucguucccugguugcuccuuggcgccuccuggcuuaucccacaaaccagcuuccuaucgaacgugugcgggcucucuauugguuuggcuuaugggcugacuuacuguuacaguauugauuugagcgagcgggucgccuuaaaguuagaucagacuuuuccuuucucccugaugcgcaggaucucaguguuuaaguaugugagcgguuccagcgcugaaagacgcgccgcccaaaguaggaaauuaaacccugucccuggaaguuaucccacccaaaguugccauccucaucucucccccucccauccgguuucccaaacucagcacgcauccggccaaaagcuggcuucuuggccuucaugcaccccuggccacaugcccacccugccaccuuaucagcccgccuccggccuguguuaugugcagaaucacuucggaccaaaucccacauccucaucaguguaccccgcuagcgcugguaccagucuagggauacagccacccacgcccgucaauagccccgguaccguuuacucuggcgcucugggaaccccaggggccgcagguaguaaagaaucuucccgaguacccaugccuuag

SEQ ID NO: 56125 - RNA, 2358 nt, Artificial Sequence
  Description of Artificial Sequence: Synthetic coding sequence
augcuugucgcuggguugcugcugugggcgucuuuacuuacaggugcuuggccuucuuuccccacacaggaccaucucccugccaccccacgagugagacuuucguucaaggagcuuaaagcaacaggaacugcucacuucuucaacuuuuugcugaacaccacugauuaucgcauccuucuuaaggacgaagaccacgaccggauguacguuggcaguaaagacuacguguugucgcuagaucuacacgacauuaacagggagccccucauuauucauugggccgcuaguccacaaaggauugaggagugcgugcuguccggaaaggacgucaacggcgaguguggaaauuucgucagacugauucaaccauggaaccggacucaccuguaugucugcgguacuggagcuuacaacccgaugugcaccuaugugaauagaggcagacgcgcucaggccaccccuuggacacaaacccaggccgugagagggcgcgggucacgagccacggauggagcccuaagaccaaugccuacugcuccaagacaggauuacauuuucuaucucgaacccgagcgauuggaauccgggaaagggaagugcccuuacgaccccaaacuggacaccgccucagcccugauaaaugaggaacuguacgcuggaguguauaucgauuucaugggaacugaugcagccauauuucgaacauuggggaagcagacggcaaugagaacugaccaguauaacagccgcuggcugaacgauccaucuuuuauacaugcugaauuaauccccgacagugcugagcguaacgaugacaaacucuacuuuuucuuucgagagcgaucagccgaggcaccacaaucccccgcuguauacgcccgcauaggaaggaucugucuuaacgaugacgguggacauuguugucuggucaauaaguggaguacuuuuuuaaaagcccggcuggugugcuccguccccggcgaggauggaauagagacgcacuuugacgaguugcaggauguguucguacagcagacgcaagaugucagaaaccccguuauauacgcuguauucaccaguuccggaaguguuuucagagguuccgccguaugcguuuauagcauggccgauauuaggaugguuuucaacggaccauucgcacacaaggaggguccuaacuaccaguggaugcccuuuuccggcaagaugccauaccccagaccuggcaccugcccgggagggacauuuacacccagcaugaaaaguacuaaagacuauccagaugagguuauuaauuuuaugagaagucacccucuuauguaucaagcaguuuauccccugcaacggagaccccugguugugcggacaggcgcccccuacaggcugaccacgaucgccguggaucagguugacgcagcagaugggagauacgagguguuauuccugggaaccgacagaggaacaguacagaaagugauugugcucccuaaagaugaucaggagcucgaagaacugauguuggaggagguugaaguguucaaagaccccgcuccagugaaaacuaugacaauaaguucgaaacgacagcaauuguacgucgccucugcuguagguguuacgcaccugucucugcauaggugucaggccuauggcgccgccugcgcugauuguuguuuagcccgagacccauauugcgccugggacggccaggccugcuccagauauacagcaucuagcaaaagacgguccaggcgacaagacguccgacauggaaacccaauucgccaguguagaggcuuuaauagcaacgccaacaaaaaugcugucgaaucagugcaguacggaguugccggcucagcagcuuuccuggagugucagccccggaguccacaagcgaccgugaaguggcuguuccagcgugaucccggagaccgcagacgcgagauucgcgccgaggaucgauuucugcguacagaacaggggcuuuugcuacgugcucuucaacuuucugacagaggccuauauucaugcacugcaacggagaacaacuuuaagcaugucgugacccgcguucaauuacacguccucggcagggaugcaguucacgccgcucucuuuccaccccucagcaugagugcuccaccuccaccuggcgccggcccccccacuccuccuuaccaggagcuugcccaacuccuugcccaaccugaaguagggcuuauucaccaguacugccagggguauuggcgccauguaccccccagccccagagaggccccuggagccccucgaucccccgagccucaagaccagaagaaaccacggaacagacgacaccauccgcccgauacuuag

SEQ ID NO: 56126 - RNA, 1269 nt, Artificial Sequence
  Description of Artificial Sequence: Synthetic coding sequence
augggcaugacaagaaugcugcuggaaugcucucuuagcgacaaacugugugugauucaagaaaagcaguacgaaguaauuauuguuccuacacuccugguaaccauauuccugauuuuauuaggagucauuuuauggcucuucauaagggaacagcgaacucagcagcagcggagcggaccucaaggaauugccccgguucccccaccucgcgaucugucuugggaagcuggucauggcggcaacgucgcacuaccucugaaagaaaccagcguggaaaauuuucugggugcuacgacgcccgcucuugccaaacugcaggucccacgcgaacagcuuucggaaguccuagagcagaucugcaguggguccugcggcccuauuuuccgcgccaauaugaauacuggugaccccuccaaaccaaaaucagugauucucaaagcgcugaaagaaccagcaggucuucacgaaguucaagacuuccugggaaggauucaauuucaccaauacuuaggaaaacauaaaaacuuaguucagcuggaagguuguugcaccgaaaagcuuccacucuauaugguacucgaagauguugcucagggcgaccuccugaguuuucuuuggacuugucgccgggacguuaugacaauggauggacugcucuacgaccugacagagaagcaaguguaccauaucgguaaacagguucugcuggcucuggaauuccugcaagagaagcaccuauuccacggagacguggcugcgcgcaauauccucaugcaaagugaccugacugccaagcuguguggacucggacuugcuuaugagguuuacacaagaggagccauaucaucgacgcaaacuaucccacugaaaugguuggccccugaaaggcucuuauuacgcccagccucaauacgcgcagacgucuggagcuuuggcauucucuuguacgaaauggugacacugggagcaccccccuauccugaagugccccccaccagcauccucgagcauuuacaacgcagaaaaaucaugaaaagacccuccucuugcacucacacuauguacaguauuaugaaaucuuguuggcgguggcgagaggccgaccgcccaucuccucgggagcuuagacugagacuugaggccgccauaaaaacagcugacgacgaggcaguacuccagguucccgagcucguggugccagaauuauaugcagccgucgcggggauccgggucgaaucucucuuuuauaauuauuccauguuguag

SEQ ID NO: 56127 - RNA, 1803 nt, Artificial Sequence
  Description of Artificial Sequence: Synthetic coding sequence
augcgcucauguuuguggaggugcagacaccugucccaaggcguccaguggagucuucuucucgccgugcugguauucuuucuuuucgcacugccgucauuuaucaaagagccgcagacuaagccgucccggcaucaacgaaccgagaacauaaaggaacgcucacuccagucccuugcuaagccaaagucucaggccccuacaagagccagaagaacaacgaucuaugcagaaccaguuccugaaaauaacgcccugaauacccagacgcagcccaaagcacauacaaccggugauagaggaaaagaagcgaaucaggcacccccugaggaacaggacaagguuccacauaccgcccagagagcagcauggaaaucaccugaaaaagagaagacuauggucaacacuuuguccccccgugggcaggacgcugggauggccagcgggagaaccgaggcccagucguggaagucacaagauacaaagacuacucaagggaacggcggacagacccggaaauugacugcaucucguacugucuccgaaaagcaucaggguaaagccgccacuacugccaaaacauuaauaccaaagagucagcaccgaaugcuggcaccaacuggcgccguuagcacccguacaagacagaagggcgugacuaccgccgugauuccucccaaagaaaaaaaaccacaagcaacucccccacccgcuccauuccaauccccuacaacccaacguaaucaaagacuuaaggcagcuaauuuuaaaucagagccccggugggauuucgaggaaaaauauucuuuugagauuggcggccuucaaacuacuugucccgauucugucaaaauaaaagccucaaaaucccucuggcugcaaaagcuguuucuuccuaaccuaacccuguuccuggauucucgccacuuuaaccagagcgaaugggacagacuugagcacuuugcccccccguucggauuuauggaguuaaauuacagccuuguccagaagguggucacucgcuuuccccccgucccgcagcaacagcuguuguuagcaucccucccugccggaucucucagauguaucaccugcgccguggucggaaauggagguauacucaacaauucacauauggggcaagagauagacucgcacgacuaugucuucagacuguccggggccuuaaucaagggcuaugaacaggacguagguacuaggacuuccuucuauggcuuuaccgcauucucccucacucagucucuguugauucugggaaauagggguuuuaaaaacguaccacuggguaaggauguccgcuacuugcacuuucucgaaggaacaagagauuacgaaugguuggaagccuugcugaugaaucagacuguuaugagcaaaaaccuguuuugguuucggcaccgcccgcaggaggcuuuucgggaggcauuacauauggauagguacuugcugcugcacccagacuucuugagauauaugaagaauagauuccugaggagcaaaacucucgacggagcucacuggaggaucuaucggccaacaacuggagcacugcuuuuguugaccgcccugcaauugugugaucaagucagugcuuauggguuuauuacagaagggcaugagagauuuagcgaucauuacuacgauacgucuuggaagagacugaucuuuuacauaaaccacgacuuuaaguuggaaagagaaguguggaagcguuugcacgaugaaggaaucauccgcuuguaccagcgucccgggccaggaacggcaaaagcgaaaaauuag

SEQ ID NO: 56128 - RNA, 780 nt, Artificial Sequence
  Description of Artificial Sequence: Synthetic coding sequence
auggccccgaacaucuaucuaguccgacagagaauaucccgccugggucaacgaaugagcggcuuucagauuaaccucaacccccugaaagaaccuuuaggcuucaucaagguccuggaguggauugcuucaauuuuugccuucgccacaugcggagguuucaaaggacagacagagauucaaguaaauugcccgccagcaguuacugagaauaagaccgucacagcuaccuucggguacccuuuucgacuuaaugaagcaucauuucaaccacccccuggugucaacauaugcgauguuaacuggaaggauuaugugcucaucggagauuacucauccagcgcccaguucuacguaacuuuugcuguguuuguguuucucuacuguaucgccgccuuacuccuuuauguaggcuacaccucacuguaucuggauucaagaaagcuccccaugauugauuucguagucacccucguggccacguucuuaugguugguuaguacauccgccugggcuaaggccuugaccgacauuaagauugcuacuggccacaauaucauugaugaacugccccccugcaaaaaaaaggcuguucuguguuauuucggcucagugacuuccaugggcucucuaaacguaagcgugauuuuuggcuuucuuaacaugauucuuugggguggcaaugcgugguuuguuuacaaggagaccagccuucacuccccaucaaauaccucugcuccccacucccagggcgguauccccccacccacaggcauuuag

SEQ ID NO: 56129 - RNA, 1299 nt, Artificial Sequence
  Description of Artificial Sequence: Synthetic coding sequence
auggacgaagccguaggagaccugaaacaggccuuaccuugcgucgcugagucuccaacuguacaugucgaagugcaccaacgcggcuccagcacugccaagaaagaagacauuaaccugucagugaggaagcuucugaacagacauaacaucguuuuuggggauuauacuuggacggaauuugaugaaccguuucuuacccgaaauguccaaucaguaucuaucauugauacagaacucaaggucaaggauucacagccaaucgaccuuucggccuguaccgucgcucugcauauuuuucagcucaaugaagacggcccaaguucagaaaaccuggaggaagaaacagaaaacauaauagcugcaaaccacuggguacucccugcugcagaguuccauggcuuaugggauagccugguuuaugaugucgagguaaagagucaucuccuggauuauguuaugacaacguuguuguucucagauaagaacgugaauaguaaucugauaaccuggaaccgcgugguucuguugcauggaccuccuggcacaggaaagacuucacucuguaaggcgcucgcacagaaacugacaauucggcucucaagucgcuauagguacggccagcuuauugaaaucaacucucacagucucuuuaguaagugguucagcgagaguggcaaauuagugacaaaaauguuccaaaagauacaagaucugauagaugacaaagacgccuugguuuucguccugauugacgagguugagagucuaaccgcagcacgaaacgcauguagggccggcaccgaaccauccgacgccauccgugucgugaaugcaguacucacccaaaucgaccagaucaagcggcauagcaacgucguaauucuaacgacauccaacauaacagaaaagaucgacguggcuuucguggaucgggcggacaucaaacaguacaucggaccuccuagcgccgccgcuauuuucaaaauuuaccuguccugucuagaggaguugaugaaaugccagaucaucuauccccgacagcagcuccugacuuugagagaguuagaaaugaucggcuuuauugaaaacaacgugagcaaacuuagcuuguugcugaaugauauauccagaaaaucugagggccugagcggacgcgucuuaagaaaacuuccauuuuuggcacaugcgcuuuaugugcaagccccuacggugaccauugaaggauuucuccaggcgcucucacuggcaguagauaagcaauucgaggaaagaaaaaaguuggccgccuacaucuag

SEQ ID NO: 56130 - RNA, 522 nt, Artificial Sequence
  Description of Artificial Sequence: Synthetic coding sequence
auggccgauacaguauuauuugaauuccuccauacagaaaugguugccgagcucugggcucacgauccugacccuggaccugguguguccgcaggacugcguggugaggaggcaggggcuacaaaaggucagaaaaugucuuuguccgugcucgaggggaugggguuucgugugggacaagcacuuggugaacgacucccuagggagacguuagcauucagagaggaacucgacgugcuuaaauuucuguguaaagaccuguggguugcaguuuuccagaaacagauggauucccuccggaccaaucaccagggcacguaugugcuacaggacaauucuuuuccucuacugcugccaauggccagcggcuugcaauaucucgaggaagcaccuaaauucuuagccuucacauguggacuucuccggggagcacuuuauacauugggcauugagucaguggucaccgcaucgguagccgccuuaccugucugcaaauuucagguuguuaucccuaagagcuag

SEQ ID NO: 56131 - RNA, 747 nt, Artificial Sequence
  Description of Artificial Sequence: Synthetic coding sequence
augauuugcacauuccugagagccguucaguacaccgagaagcuacauagauccuccgcaaagaggcugcuucugccauauauuguuuugaacaaagcgugucuuaagaccgaaccgucccuccgguguggccugcaauaucagaaaaaaaccuugaggccaagguguauccucggaguuacgcagaaaacuaucuggacacagggcccuagucccaggaaagcuaaagaggauggguccaaacaaguaagcgugcacaggagucaaagggggggcacugccgugccuacgagccagaaagugaaagaagcuggacgggacuuuacauaucugauuguaguccucuucggaauaucaauaacagggggucucuuuuauacgauuuuuaaagaacuauucucuuccucuucacccuccaagaucuaugggagggcacucgagaaaugcagaucccauccugaaguaaucggcguguuuggggagucaguuaagggcuauggggaggucaccagacgcgggcggaggcagcacguuagauucacugaguauguaaaagacggacuaaagcacacaugugugaaguuuuauauugagggcucugaaccaggaaagcagggcaccgucuacgcccaggugaaagagaauccaggauccggagaauacgacuuuagguacauuuuugucgagauugaaagcuacccuaggcggaccaucaucaucgaggacaauagaucucaagacgacuag

SEQ ID NO: 56132 - RNA, 1257 nt, Artificial Sequence
  Description of Artificial Sequence: Synthetic coding sequence
auguaccgaccagcuagggugacuuccacaagccgcuuucuuaacccauaugucguuuguuuuaucguaguugcuggcgugguaauucuggccgucacuauagcucucuuaguguacuuucuggcauucgaucagaagucuuauuuuuaccguucuagcuuccaauugcucaauguggaguauaacagucaacucaauucaccagccacacaggaauaucggacacucucuggucgaauugagagucuuaucacuaaaaccuuuaaggaaagcaaucucagaaaucaguuuauccgggcacauguugcuaaauuacgccaggaugguuccggcguaagagcagacguagugaugaaauuucaauuuacgagaaauaacaacggagcuaguaugaaaaguaggaucgaguccguacugagacaaaugcucaauaacagcgguaaccuagagaucaauccgucaacagaaauuacaucucugaccgaccaggccgccgccaacuggcugauuaaugagugcggcgcgggccccgauuugauuacccugucugaacagcgaauacuuggaggaaccgaagcagaagagggaucuuggccuuggcaagugucacuuagauugaacaaugcucaccauuguggaggaucccuuauuaacaauauguggauucugaccgcugcacacuguuucaggucaaacagcaacccacgcgauuggauagccacuucaggcauuagcacaacauucccaaaacuacgaaugagaguuaggaacauacucauacauaauaauuauaagagcgcgacacaugaaaaugacaucgcccuggugagacuagaaaacuccgugacuuuuacgaaagacauucauuccgucugucucccugcggcaacccagaauauuccgccaggcucaacggcguaugucaccggauggggcgcucaggaauaugcaggccauaccguuccagaacuccgacagggccaggugcggauuauaucaaaugaugugugcaaugcgccgcacucuuacaacggcgcaauacuaagcgguaugcugugugccggcguaccgcaaggcggaguggacgcgugucagggugacucaggaggaccucucgugcaggaggauaguagaaggcugugguuuaucguggguaucgugucuuggggggaucagugcggccuacccgacaaaccagggguuuauacucgggucacugccuauuuagacuggauaagacaacagacugggauuuag

SEQ ID NO: 56133 - RNA, 906 nt, Artificial Sequence
  Description of Artificial Sequence: Synthetic coding sequence
augaaguuccaauucacacguaauaauaauggcgccucaaugaagagucgcauugaguccguucugagacagaugcucaacaacucagggaaucuggaaauuaaucccucuaccgaaaucaccagccugaccgaucaggccgcagcaaacuggcucaucaacgaaugcggcgcaggaccagacuugauaaccuuaucugaacagagaauucugggcgggacagaggcugaggagggcaguuggccuuggcaggugagccugagacuaaauaaugcgcaucauugcggcgguucccuaauuaauaacauguggauucuaacagccgcccacugcuuccguucaaacucuaacccacgggauuggaucgccaccuccgguaucucuacaaccuucccaaaacucagaaugcgggugaggaacauauugauucacaauaauuauaagucugccacccacgaaaacgauaucgcccuagucagguuggaaaacucgguaacguucaccaaggacauucacucggucugucugccagccgccacacagaauaucccacccggauccacugcuuaugugacuggcuggggagcacaggaauaugccggacacacuguuccugaguuacggcaaggacaggugagaaucauaagcaaugauguguguaacgccccccauucuuauaacggggccauacugagugggauguugugugcgggcgugccacagggcgguguggaugcuugccaaggggacuccggaggaccccuggugcaagaggauucgagacggcuuugguucauaguggggauaguuuccuggggcgaccagugcggacucccugacaaaccuggggucuacacaagagugacggcauacuuagacuggauuagacagcagacgggaaucuag

SEQ ID NO: 56134 - RNA, 1440 nt, Artificial Sequence
  Description of Artificial Sequence: Synthetic coding sequence
auggccguucucgguguucaacugguaguuacccugcugaccgccacacucaugcauaggcucgcgccucacuguuccuuugcgaggugguugcuguguaauggcucccuguuucgauacaaacacccaagcgaggaagaguuaagggcauuggcggguaagccaagaccucggggcagaaaggagagaugggcuaacggacuaucugaggagaaacccuugucuguuccacgggacgcuccauuccagcuugaaacaugcccucuuaccacuguagacgcucugguacucagguucuuucucgaauaccagugguuugucgauuucgcaguauacuccggcggcgucuaccuguuuacagaggccuauuauuauaugcuggggcccgccaaggaaaccaauaucgcuguguucuggugucuucugacaguuacauucagcaucaaaauguuuuugacggugacucgucucuauuuuagugccgaagagggaggagaaagaucuguuugccugaccuucgcuuuccuauuucuccugcucgcaaugcuaguucaagugguacgcgaggagaccuuagagcuuggcuuggaaccagggcuugccucuaugacucagaaucuugaaccucuucugaaaaagcagggcugggacugggcacugccuguggcgaagcucgcaaucagagucggccuggcuguagugggcuccgugcugggggccuuucuuacuuuucccggacugagacucgcucagacgcaccgcgacgcacuaacaaugucugaagaucggccuaugcuucaauuucugcuucacacauccuuucuuuccccucuguuuauauuguggcuguggacuaagccgauugcgcgggauuuucuucaucagccuccuuucggggagacaagauucucgcuucucuccgauuccgcauucgacuccgguagauuguggcuguuggucguucugugccugcugcgucuggccguuacacggccgcaucugcaagcauaccuuugucuggcuaaggcacgaguagaacaguugcggcgggaagcuggccggaucgaagccagagagauacaacagcgaguuguaagaguguauugcuacguaaccguuguuucauugcaguaccugacaccccucauucugacccucaacugcaccuuacuccucaaaacuuuaggcggcuauaguuggggauuagggccugcuccucuccuuucuccagauccaucaucagcauccgcagcuccuaucgguucaggcgaagaugagguccagcagacugcugcaaggauugccggugccuuggguggccuccuuaccccucuauucuugagaggugugcuagcuuaccugaucugguggacugcugccugccagcuucuggccucuuuauucgggcuguacuuucaucagcacuuagccggaaguuag

SEQ ID NO: 56135 - RNA, 708 nt, Artificial Sequence
  Description of Artificial Sequence: Synthetic coding sequence
augggaacugcagacuccgacgaaauggcaccagaggcgccccagcacacccacaucgacgugcauauccaucaggaauccgccuuggcuaagcuccuacuaacauguuguuccgcacuuagaccucgcgcuacucaagcccgcggcucaagucggcugcugguugcuuccugggugaugcaaaucguuuuagguauuuuauccgcgguccuaggaggauuuuuuuauauucgggacuauacucugcucguuaccagcggcgccgcgauauggacuggugcaguggccguacucgcaggcgcugcugcauuuauauacgaaaagcgaggaggcacauacugggcuuugcugcggacauuauugacucuggccgcguuuaguaccgcaauugccgcucugaaauuauggaaugaagauuuccguuacggcuacaguuacuauaacucagccugccguaucuccucuucauccgacuggaacaccccugcccccacacagucccccgaggaaguucgccgauuacaccucugcacuucuuuuauggauaugcugaaagcacuguuucgcacacuccaggccauguuauugggcguauggauucuacugcuacuugccucguugacuccacuauggcuuuauugcuggcgaauguucccaacuaaaggaaagagggaccaaaaagagaugcuugagguguccgguauauag

SEQ ID NO: 56136 - RNA, 8487 nt, Artificial Sequence
  Description of Artificial Sequence: Synthetic coding sequence
augcccaaaagggcccauuggggugcucugagcgucgugcucauuuugcugugggggcacccccgcguggcccuggcuugcccucauccuugcgccugcuacguucccucugaagugcacugcacauuuagaucauuagccucgguaccugccggaaucgccaaacacgucgagcgcaucaacuuaggcuucaacuccauccaagcauuauccgagacauccuuugcaggccugacaaaacucgagcuuuuaaugauacauggaaacgaaauuccuucuauucccgacggugcccucagagaccuuuccucucuucaaguuuuuaaguucucuuacaacaaacugcgcgucaucaccggccaaacuuuacagggacuaagcaaucucaugcggcugcauaucgaccacaacaaaaucgaguuuauucauccucaggcguuuaacgggcugacaucacugcgccuccugcacuuagaggguaaucuccuucaucagcuacaucccucgacuuuuaguaccuucacguuucuagauuacuuuaggcuuucuaccaucagacauuuguaucuagccgagaacaugguucgaacacugccagcaucaaugcucagaaauaugccgcugcuggaaaaccucuaccugcaaggaaacccguggacgugcgacugugagaugaggugguuucucgaaugggacgccaaaucccgcggcauucugaaaugcaagaaagauaaagcuuaugaagggggacagcuaugcgcaaugugcuucucccccaagaaacuauauaaacaugaaauccacaaauugaaagauaugacgugucugaaacccucuauugaauccccgcugcgccaaaaccguucuaggucuauagaagaggaacaggaacaagaagaagacggcggcucacaacuaauccuggaaaaauuccaacuuccccaauggagcaucucccugaacaugacugaugagcacggaaauaugguuaaucucgucugcgauaucaagaagcccauggacguguauaaaauacaccugaaccagacggauccucccgauaucgacaucaaugccacaguggcccuugacuuugagugcccaaugacccgagaaaauuacgaaaagcucuggaaacuuaucgcguacuacucagaagugccugugaaacuacaccgagaacugaugcuaaguaaagacccaagagugaguuaccaguacaggcaagacgccgacgaagaggcuuuauacuauacaggagugcgggcccagauccucgcagagccggagugggugaugcagccaagcauugacauacaacuaaaucgacggcaauccacagcuaagaaaguucuguuaagcuacuacacacaguacucccaaacaauuuccaccaaagauacaagacaggcuagaggccgcucuugggucaugauugaaccaagcggcgcgguccagcgagaccagacuguacuagagggcggcccaugucaacuguccuguaacguaaaagcaagcgagucuccuuccauuuucuggguccuaccugacgggucaauucuuaaagcgccaauggaugauccagauucaaaguuuucaauucuauccuccggguggcuacgaaucaaaucaauggaacccucggacucaggauuguaucagugcaucgcacaggugcgggacgaaauggacagaaugguuuaucgggucuuggugcagagcccuucuacucagccagcugagaaggacacagugacaauugguaaaaauccuggagagagcgucacccugcccuguaacgcucuugcuauccccgaggcccaucuuagcuggauuuugcccaacagacggauuauaaaugaucucgcaaacaccucccauguguacaugcugccaaauggaacucuaagcauccccaaagugcaagucagcgauaguggauacuauagaugugucgccguaaaccagcagggcgcagaccauuucaccguggguaucacagucacaaaaaaaggcucuggccugcccucaaagcgcggccgccgucccggagcaaaggcucucagucggguccgagaagacaucguugaagaugaagggggcagcggcaugggggaugaggaaaacaccucaaggaggcuccugcacccaaaggaccaggaaguguuucugaagacuaaagaugacgcaauuaauggagauaagaaggcaaaaaaggggagaaggaagcugaaguuauggaaacauuccgaaaaggagcccgaaacuaacguggccgagggaaggcggguguuugaauccaggcguagaauaaacauggcaaauaaacaaaucaacccggagaggugggcugauaucuuagccaagguucguggaaaaaaccucccuaaaggaacagaagugcccccucugaucaagaccacuucucccccuagccugucccuugaaguuacuccucccuuucccgccauaucaccgccuucagccagccccguacaaacaguuaccagugcggaggagagcucugcagaugugccccuguuaggagaagaggagcauguccucggcaccauuucuagcgcuucuaugggcuuagaacacaaccacaauggcgucaucuuagucgagccggaagucaccucaaccccuuuggaagaggucguggacgaucugucugagaagaccgaggaaauuaccucuaccgaaggagaccucaaaggaacggcagcuccaacacuaaucagcgaacccuacgaacccagccccacucugcacacccuggacaccguguacgaaaagccaacucacgaagaaaccgccaccgaaggcugguccgcugcugacguuggcagcucccccgaacccaccucuucugaauaugaacccccuuuggaugcuguuucuuuagccgaaucugagcccaugcaguacuuugacccugaccuagagacaaagagccaaccagacgaggacaaaaugaaggaagauaccuuugcucaccugacccccaccccuaccauuuggguaaacgauaguagcacaucucaacuauucgaagauuccacaauuggugaaccuggaguccccggccagucucacuuacaggggcugacggacaacauucaccuugucaagaguagucucagcacacaggacacccuucuaauaaaaaaaggaaugaaggaaaugagccagaccuuacagggcggcaauaugcuggaaggcgauccaacacacagucgcagcucagaaucagagggacaagaaucaaaaucaauuaccuuacccgacaguacauuggggaucaugagcagcaugagucccguuaagaagcccgccgagacuacuguggggacccuccuggauaaagauacaacaacagcuacuacaaccccccgccaaaaggucgcaccuaguuccaccaugucaacacacccaucacgaagacgaccgaacggccgccgacgccucaggccaaacaaauucagacaucggcacaagcagaccccucccacgacuuucgcccccucugagaccuucuccacccaaccgacacaggcaccagauaucaagaucucaucucaggucgaaucaucgcuaguucccacugcauggguugauaauaccgugaauaccccuaagcagcucgaaauggagaagaaugcugagcccaccuccaaaggcacgccccgccgaaaacauggcaaaagaccuaacaagcacagauacacgccauccaccgucucuucaagagcaucaggaucaaagccaucaccuagcccagaaaacaagcaucgaaacauugucacaccgagcucagaaaccauccugcugccccguaccgucuccuugaagacagaagguccauacgacagucuggacuauaugaccaccaccaggaaaaucuauucaucuuacccaaaaguacaagaaacccugccagugacuuacaagcccaccuccgacgggaaagagaucaaagacgauguagcuacaaauguggauaagcauaagagcgauauucuggucacgggcgagucgauuacaaacgcuauuccaacaucccggagucuugugucaacaaugggagaauucaaagaggaaaguucgcccgucgguuuccccggaacuccaacuuggaaccccucucggaccgcacaaccaggccgguugcagacagguauucccguuaccacaagcggcgagaaccuaacugacccuccgcuacugaaggaacuugaggaugucgacuuuacgagcgaguuucucucaucucuaacggugagcacuccauuccaccaagaggaggccggcucuucuaccacucugagcuccauuaaaguggaaguggcuucuucacaagcugagacuacaacucuugaccaggaucacuuagagacaacuguagcaauucuacuaagcgagacacggccccagaaucacaccccaacagccgcccggaugaaagagcccgcaaguucaagccccaguaccaucuugaugucccucggacagacaacuacaacaaagccagcccucccuucuccucgcauuucgcaggccuccagggacagcaaagagaauguuuuccucaacuauguuggaaauccagaaacagaggcaacgccagucaacaacgaaggcacgcagcacaugagcgggccaaacgaauuaagcacacccagcucugaccaagacgcuuuuaaccugaguacaaaacuggaacucgagaaacaaguuuucggcagccgaucuuugccacggggccccgauucccagcgccaggauggccgagugcaugccucccaccaacuuacgagggugccugcgaaaccuauucugccaacugccacugucagacucccagaaauguccacucaguccgcuucucgcuacuucgugacgucacaaucuccccgccauuggacaaacaaaccagagauuacaacauauccuaguggggcacucccugagaacaagcaguucaccacaccucgccuuucaucuacuacuauaccccugccgcuccauaugucaaaacccuccauuccaucuaaauucaccgaccguagaacugaucaguucaacggcuacucaaagguauucgguaauaauaacauuccugaagcaagaaaccccgugggaaaaccacccagcccccguaucccucauuauuccaauggucggcuucccuucuucacaaauaaaacacugagcuucccacaguugggagucacaagacgcccacaaauuccuaccaguccugcucccguuaugagagagagaaaaguaauuccaggcuccuauaacagaauacauucgcauucaaccuuucaucuugauuuuggcccucccgccccuccccuccugcacacaccacagaccaccgggagccccucaacaaaccuucagaacauccccauggucuccuccacacaaucauccauuucuuucaucacuaguucaguccaguccagcggcuccuuucaucaguccaguuccaaguuuuucgccggggguccccccgcuagcaaguucuggucucugggagaaaaaccucaaauacugaccaaauccccccagacagucagcguuacggcagaaaccgacaccgucuuucccugcgaggccacgggaaaaccuaaacccuucguuacauggacaaaaguuucuacgggggcucucaugaccccuaacacuagaauccaaagauucgaaguacugaaaaaugggacccucguuauccgcaaaguccagguucaagaucgcgggcaguauauguguacggcgucaaauuuacauggucucgaucgcauggucguacugcugagcguaacugugcagcagccacagauucuggccucucacuaccaggauguuaccgucuauuuaggcgacacaauagcuauggagugcuuagcuaaagguaccccagccccucagauuaguuggauauuccccgaucgaagaguuuggcagacuguuuccccuguagaaggaagaauuacccugcacgaaaaccgcacccucucuauaaaagaagccagcuucucagaccggggcgucuauaaguguguugccucuaaugcagcaggugccgacucccuugccauuagauugcacguggcggcccucccacccgucauccaccaagagaaauuggagaacauuucucugccuccuggccuguccauucacauacacugcaccgcaaaggccgcaccgcugccuuccguucgauggguauugggggauggaacucaaauuagaccaucacaguuuuuacaugggaaucuguuuguauuucccaacggcacccuauauauacgcaaucuugcucccaaggacucagguagauaugaguguguugccgcuaaccuaguggguucugcccggaggaccguccaacucaacguccagcgugcagcugcuaacgcgcgaauuaccggcacgaguccacgacgaacagaugugcguuauggugguacucugaaacuugacugcagcgccagcggggauccuuggccacgaauacuuuggcgucuucccagcaagaggaugaucgaugcucucuucucguucgauucgaggauuaagguguucgcgaacgggacucucguuguuaaaagcguuaccgauaaggacgcuggcgauuaccuuuguguagcaagaaacaagguaggagaugacuauguggugcugaagguugacgugguuaugaagccggccaaaauugagcauaaagaggagaacgaucacaaaguauucuauggcggggaccucaaaguggauugcguagcaacaggccugccgaacccagaaaucucuuggagcuugccggauggaaguuuggucaacuccuuuaugcagucugaugauagcggaggcagaacgaaacgcuauguggucuucaauaauggaacacuguacuuuaacgaagugggcaugagagaggagggggauuacaccugcuuugcagagaaccagguuggaaaggacgagaugaggguuagggugaagguuguuacagcuccugcuacgauuagaaauaagacauaucuugcgguccaagugcccuauggggacgucgucaccguagcuugugaggcaaaaggcgagccuaugcccaaggugaccuggcugagccccacuaacaaagugaucccuacaucaagcgaaaaauaccagaucuaucaggauggaacccucuuaauucagaaggcccaaagaucugacucuggaaauuauacuugucugguucggaacuccgccggugaggaucgcaaaaccguuuggauccacguuaauguccagccacccaagauuaauggcaaccccaacccuaucaccaccgugcgagaaauagcugcuggggggucuagaaagcucaucgauugcaaagccgaaggcauucccacaccacgcguccucugggcauuccccgagggaguugugcuucccgcaccuuacuacggaaacaggaucacaguacaugggaauggcucacucgacauuaggucucuucgaaaauccgacagcgugcaguuaguuuguauggcacgcaaugaagguggugaagcgcgcuugauucugcagcucacaguguuagagccgauggagaaaccuauauuucacgaccccauuagcgagaagauuacagcuauggccggucacacuauuucuuuaaauuguucagccgcgggcacuccaacacccuccuuggucuggguacucccaaauggaaccgaucuacaaucuggacagcaguugcagagguucuaucauaaagcagacgggaugcuccauauuaguggucuaagcaguguggaugcuggggcauacaggugcguagcccggaacgcagcaggacacacagaaaggcugguuagccugaaagucggccugaaacccgaagccaauaagcaguaccacaaucucgugaguaucaucaacggugaaacacugaaauugcccuguacaccccccggcgccggccaagggagguucaguuggacacuacccaaugggaugcaucucgaggggccacagacucugggacgaguuucccuccuggacaauggcacacucacugugcgcgaagccuccgucuuugauagaggcacuuauguaugcaggauggagaccgaauacggaccuucugucaccucuauuccugugauagugauagccuauccaccaaggauaacaucugaaccgacgccugugaucuauacuagacccggcaauaccgugaaacuuaacuguauggccauggguauuccaaaagccgauauuaccugggaacugccugacaaaagccaucuuaaagccggaguacaagccagacucuacgggaaccgguuucugcacccucaaggaucucuaacuauacagcacgccacccaaagagacgccgguuuuuacaaauguauggcaaagaacauccugggcagcgauucuaaaacaacuuacauacacguuuuuuag

SEQ ID NO: 56137 - RNA, 921 nt, Artificial Sequence
  Description of Artificial Sequence: Synthetic coding sequence
auggcugcuguggacgaucugcaauucgaggaauuuggcaacgcggcaacuagccugacagcaaaucccgaugcuacaacuguaaacauagaggacccuggagaaacaccaaaacaccagcccggaucuccuagaggaucaggacgcgaagaagaugacgagcugcugggaaacgacgauagcgauaagacggaauuacucgccgggcagaagaaguccagccccuucuggaccuuugaauacuaucaaaccuuuuuugacguugacaccuaccaagucuuugaucggauuaaggggagccugcuaccaaucccaggcaagaauuuugugcgacuauacauucgcaguaacccugaccuguauggccccuuuuggauuugugcaacccuaguguucgccauugcuauauccggcaauuuaagcaauuuccugauccauuuaggagaaaaaaccuaucacuacgucccugaguuccguaagguguccaucgcggccacuauaaucuaugcuuaugcuuggcucgucccucucgcacuguggggguuucucauguggagaaacucaaaagugaugaacauugugucuuacuccuuucuagagaucguuugcguauacggcuauucccucuucaucuacaucccuacagccauucuuuggaucaucccccagaaagcggugcgauggauccuggugaugauagcgcuggggaucucugggagcuuauuggcaaugacuuuuuggccugcagugcgagaagacaauaggcguguugcacuagcuacaaucguaacuaucguccugcugcauauguugcucucuguugguugucuggccuauuucuuugaugcgccugagauggaccacuuaccuacuacaaccgccacaccuaaccagaccgucgccgcagccaagucuucauag

SEQ ID NO: 56138 - protein, 4 aa, Homo sapiens
  MOD_RES (2)..(3): Any amino acid
RXXR

SEQ ID NO: 56139 - protein, 4 aa, Homo sapiens
  MOD_RES (2)..(2): Any amino acid
  MOD_RES (3)..(3): Lys or Arg
RXXR

SEQ ID NO: 56140 - protein, 6 aa, Homo sapiens
  MOD_RES (1)..(1): Lys or Arg
  MOD_RES (2)..(5): Any amino acid
  MOD_RES (6)..(6): Lys or Arg
XXXXXX

SEQ ID NO: 56141 - protein, 8 aa, Homo sapiens
  MOD_RES (1)..(1): Lys or Arg
  MOD_RES (2)..(7): Any amino acid
  MOD_RES (8)..(8): Lys or Arg
XXXXXXXX

SEQ ID NO: 56142 - protein, 6 aa, Homo sapiens
LVPRGS

SEQ ID NO: 56143 - protein, 4 aa, Homo sapiens
LVPR

SEQ ID NO: 56144 - protein, 4 aa, Homo sapiens
  MOD_RES (1)..(1): Ala, Phe, Gly, Ile, Leu, Thr, Val or Met
  MOD_RES (2)..(2): Ala, Phe, Gly, Ile, Leu, Thr, Val or Trp
XXPR

SEQ ID NO: 56145 - protein, 4 aa, Homo sapiens
IEGR

SEQ ID NO: 56146 - protein, 4 aa, Homo sapiens
IDGR

SEQ ID NO: 56147 - protein, 4 aa, Homo sapiens
AEGR

SEQ ID NO: 56148 - protein, 4 aa, Homo sapiens
  MOD_RES (1)..(1): Ala, Phe, Gly, Ile, Leu, Thr, Val or Met
  MOD_RES (2)..(2): Asp or Glu
XXGR

SEQ ID NO: 56149 - DNA, 615 bp, Homo sapiens
atggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctga

SEQ ID NO: 56150 - DNA, 800 bp, Artificial Sequence
  Description of Artificial Sequence: Synthetic transcript sequence
taatacgactcactatagggaaataagagagaaaagaagagtaagaagaaatataagagccaccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 56151 - DNA, 800 bp, Artificial Sequence
  Description of Artificial Sequence: Synthetic transcript sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 56152 - RNA, 758 nt, Artificial Sequence
  Description of Artificial Sequence: Synthetic transcript sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugaagcgcugccuucugcggggcuugccuucuggccaugcccuucuucucucccuugcaccuguaccucuuggucuuugaauaaagccugaguaggaag

SEQ ID NO: 56153 - RNA, 854 nt, Artificial Sequence
  Description of Artificial Sequence: Synthetic transcript sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaugauaagcugccuucugcggggcuugccuucuggccaugcccuucuucucucccuugcaccuguaccucuuggucuuugaauaaagccugaguaggaag

SEQ ID NO: 56154 - DNA, 896 bp, Artificial Sequence
  Description of Artificial Sequence: Synthetic transcript sequence
taatacgactcactatagggaaataagagagaaaagaagagtaagaagaaatataagagccaccatggtatccaagggggaggaggacaacatggcgatcatcaaggagttcatgcgattcaaggtgcacatggaaggttcggtcaacggacacgaatttgaaatcgaaggagagggtgaaggaaggccctatgaagggacacagaccgcgaaactcaaggtcacgaaagggggaccacttcctttcgcctgggacattctttcgccccagtttatgtacgggtccaaagcatatgtgaagcatcccgccgatattcctgactatctgaaactcagctttcccgagggattcaagtgggagcgggtcatgaactttgaggacgggggtgtagtcaccgtaacccaagactcaagcctccaagacggcgagttcatctacaaggtcaaactgcgggggactaactttccgtcggatgggccggtgatgcagaagaaaacgatgggatgggaagcgtcatcggagaggatgtacccagaagatggtgcattgaagggggagatcaagcagagactgaagttgaaagatgggggacattatgatgccgaggtgaaaacgacatacaaagcgaaaaagccggtgcagcttcccggagcgtataatgtgaatatcaagttggatattacttcacacaatgaggactacacaattgtcgaacagtacgaacgcgctgagggtagacactcgacgggaggcatggacgagttgtacaaatgataagctgccttctgcggggcttgccttctggccatgcccttcttctctcccttgcacctgtacctcttggtctttgaataaagcctgagtaggaaggcggccgctcgagcatgcatctaga

SEQ ID NO: 56155 - RNA, 725 nt, Artificial Sequence
  Description of Artificial Sequence: Synthetic transcript sequence
gggaaauaagagagaaaagaagaguaagaagaaauauaagagccaccaugggagugcacgagugucccgcgugguugugguugcugcugucgcucuugagccucccacugggacugccugugcugggggcaccacccagauugaucugcgacucacggguacuugagagguaccuucuugaagccaaagaagccgaaaacaucacaaccggaugcgccgagcacugcucccucaaugagaacauuacuguaccggauacaaaggucaauuucuaugcauggaagagaauggaaguaggacagcaggccgucgaaguguggcaggggcucgcgcuuuugucggaggcgguguugcggggucaggcccuccucgucaacucaucacagccgugggagccccuccaacuucaugucgauaaagcggugucggggcuccgcagcuugacgacguugcuucgggcucugggcgcacaaaaggaggcuauuucgccgccugacgcggccuccgcggcaccccuccgaacgaucaccgcggacacguuuaggaagcuuuuuagaguguacagcaauuuccuccgcggaaagcugaaauuguauacuggugaagcguguaggacaggggaucgcugauaagcugccuucugcggggcuugccuucuggccaugcccuucuucucucccuugcaccuguaccucuuggucuuugaauaaagccugaguaggaag

SEQ ID NO: 56156 - RNA, 1536 nt, Artificial Sequence
  Description of Artificial Sequence: Synthetic transcript sequence
gggaaauaagagagaaaagaagaguaagaagaaauauaagagccaccaaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugaucagccagcgcugccuucugcggggcuugccuucuggccaugcccuucuucucucccuugcaccuguaccucuuggucuuugaauaaagccugaguaggaag

SEQ ID NO: 56157 - DNA, 767 bp, Artificial Sequence
  Description of Artificial Sequence: Synthetic transcript sequence
taatacgactcactatagggaaataagagagaaaagaagagtaagaagaaatataagagccaccatgggagtgcacgagtgtcccgcgtggttgtggttgctgctgtcgctcttgagcctcccactgggactgcctgtgctgggggcaccacccagattgatctgcgactcacgggtacttgagaggtaccttcttgaagccaaagaagccgaaaacatcacaaccggatgcgccgagcactgctccctcaatgagaacattactgtaccggatacaaaggtcaatttctatgcatggaagagaatggaagtaggacagcaggccgtcgaagtgtggcaggggctcgcgcttttgtcggaggcggtgttgcggggtcaggccctcctcgtcaactcatcacagccgtgggagcccctccaacttcatgtcgataaagcggtgtcggggctccgcagcttgacgacgttgcttcgggctctgggcgcacaaaaggaggctatttcgccgcctgacgcggcctccgcggcacccctccgaacgatcaccgcggacacgtttaggaagctttttagagtgtacagcaatttcctccgcggaaagctgaaattgtatactggtgaagcgtgtaggacaggggatcgctgataagctgccttctgcggggcttgccttctggccatgcccttcttctctcccttgcacctgtacctcttggtctttgaataaagcctgagtaggaaggcggccgctcgagcatgcatctaga

SEQ ID NO: 56158 - DNA, 750 bp, Artificial Sequence
  Description of Artificial Sequence: Synthetic transcript sequence
taatacgactcactatagggaaataagagagaaaagaagagtaagaagaaatataagagccaccatgggagtgcacgagtgtcccgcgtggttgtggttgctgctgtcgctcttgagcctcccactgggactgcctgtgctgggggcaccacccagattgatctgcgactcacgggtacttgagaggtaccttcttgaagccaaagaagccgaaaacatcacaaccggatgcgccgagcactgctccctcaatgagaacattactgtaccggatacaaaggtcaatttctatgcatggaagagaatggaagtaggacagcaggccgtcgaagtgtggcaggggctcgcgcttttgtcggaggcggtgttgcggggtcaggccctcctcgtcaactcatcacagccgtgggagcccctccaacttcatgtcgataaagcggtgtcggggctccgcagcttgacgacgttgcttcgggctctgggcgcacaaaaggaggctatttcgccgcctgacgcggcctccgcggcacccctccgaacgatcaccgcggacacgtttaggaagctttttagagtgtacagcaatttcctccgcggaaagctgaaattgtatactggtgaagcgtgtaggacaggggatcgctgataagctgccttctgcggggcttgccttctggccatgcccttcttctctcccttgcacctgtacctcttggtctttgaataaagcctgagtaggaaggcggccgc

SEQ ID NO: 56159 - DNA, 1578 bp, Artificial Sequence
  Description of Artificial Sequence: Synthetic transcript sequence
taatacgactcactatagggaaataagagagaaaagaagagtaagaagaaatataagagccaccaatgcagcgcgtcaacatgattatggccgaatcgccgggactcatcacaatctgcctcttgggttatctcttgtcggcagaatgtaccgtgttcttggatcacgaaaacgcgaacaaaattcttaatcgcccgaagcggtataactccgggaaacttgaggagtttgtgcagggcaatcttgaacgagagtgcatggaggagaaatgctcctttgaggaggcgagggaagtgtttgaaaacacagagcgaacaacggagttttggaagcaatacgtagatggggaccagtgtgagtcgaatccgtgcctcaatgggggatcatgtaaagatgacatcaatagctatgaatgctggtgcccgtttgggtttgaagggaagaactgtgagctggatgtgacgtgcaacatcaaaaacggacgctgtgagcagttttgtaagaactcggctgacaataaggtagtatgctcgtgcacagagggataccggctggcggagaaccaaaaatcgtgcgagcccgcagtcccgttcccttgtgggagggtgagcgtgtcacagactagcaagttgacgagagcggagactgtattccccgacgtggactacgtcaacagcaccgaagccgaaacaatcctcgataacatcacgcagagcactcagtccttcaatgactttacgagggtcgtaggtggtgaggacgcgaaacccggtcagttcccctggcaggtggtattgaacggaaaagtcgatgccttttgtggaggttccattgtcaacgagaagtggattgtcacagcggcacactgcgtagaaacaggagtgaaaatcacggtagtggcgggagagcataacattgaagagacagagcacacggaacaaaagcgaaatgtcatcagaatcattccacaccataactataacgcggcaatcaataagtacaatcacgacatcgcacttttggagcttgacgaacctttggtgcttaattcgtacgtcacccctatttgtattgccgacaaagagtatacaaacatcttcttgaaattcggctccgggtacgtatcgggctggggcagagtgttccataagggtagatccgcactggtgttgcaatacctcagggtgcccctcgtggatcgagccacttgtctgcggtccaccaaattcacaatctacaacaatatgttctgtgcgggattccatgaaggtgggagagatagctgccagggagactcagggggtccccacgtgacggaagtcgaggggacgtcatttctgacgggaattatctcatggggagaggaatgtgcgatgaaggggaaatatggcatctacactaaagtgtcacggtatgtcaattggatcaaggaaaagacgaaactcacgtgatcagccagcgctgccttctgcggggcttgccttctggccatgcccttcttctctcccttgcacctgtacctcttggtctttgaataaagcctgagtaggaaggcggccgctcgagcatgcatctaga

SEQ ID NO: 56160 - RNA, 851 nt, Artificial Sequence
  Description of Artificial Sequence: Synthetic transcript sequence
gggaaauaagagagaaaagaagaguaagaagaaauauaagagccaccauggugagcaagggcgaggaggauaacauggccaucaucaaggaguucaugcgcuucaaggugcacauggagggcuccgugaacggccacgaguucgagaucgagggcgagggcgagggccgccccuacgagggcacccagaccgccaagcugaaggugaccaaggguggcccccugcccuucgccugggacauccuguccccucaguucauguacggcuccaaggccuacgugaagcaccccgccgacauccccgacuacuugaagcuguccuuccccgagggcuucaagugggagcgcgugaugaacuucgaggacggcggcguggugaccgugacccaggacuccucccugcaggacggcgaguucaucuacaaggugaagcugcgcggcaccaacuuccccuccgacggccccguaaugcagaagaagaccaugggcugggaggccuccuccgagcggauguaccccgaggacggcgcccugaagggcgagaucaagcagaggcugaagcugaaggacggcggccacuacgacgcugaggucaagaccaccuacaaggccaagaagcccgugcagcugcccggcgccuacaacgucaacaucaaguuggacaucaccucccacaacgaggacuacaccaucguggaacaguacgaacgcgccgagggccgccacuccaccggcggcauggacgagcuguacaagugagcugccuucugcggggcuugccuucuggccaugcccuucuucucucccuugcaccuguaccucuuggucuuugaauaaagccugaguaggaag

SEQ ID NO: 56161 - DNA, 1838 bp, Artificial Sequence
  Description of Artificial Sequence: Synthetic transcript sequence
taatacgactcactatagggaaataagagagaaaagaagagtaagaagaaatataagagccaccatggaagatgcgaagaacatcaagaagggacctgccccgttttaccctttggaggacggtacagcaggagaacagctccacaaggcgatgaaacgctacgccctggtccccggaacgattgcgtttaccgatgcacatattgaggtagacatcacatacgcagaatacttcgaaatgtcggtgaggctggcggaagcgatgaagagatatggtcttaacactaatcaccgcatcgtggtgtgttcggagaactcattgcagtttttcatgccggtccttggagcacttttcatcggggtcgcagtcgcgccagcgaacgacatctacaatgagcgggaactcttgaatagcatgggaatctcccagccgacggtcgtgtttgtctccaaaaaggggctgcagaaaatcctcaacgtgcagaagaagctccccattattcaaaagatcatcattatggatagcaagacagattaccaagggttccagtcgatgtatacctttgtgacatcgcatttgccgccagggtttaacgagtatgacttcgtccccgagtcatttgacagagataaaaccatcgcgctgattatgaattcctcgggtagcaccggtttgccaaagggggtggcgttgccccaccgcactgcttgtgtgcggttctcgcacgctagggatcctatctttggtaatcagatcattcccgacacagcaatcctgtccgtggtaccttttcatcacggttttggcatgttcacgactctcggctatttgatttgcggtttcagggtcgtacttatgtatcggttcgaggaagaactgtttttgagatccttgcaagattacaagatccagtcggccctccttgtgccaacgcttttctcattctttgcgaaatcgacacttattgataagtatgacctttccaatctgcatgagattgcctcagggggagcgccgcttagcaaggaagtcggggaggcagtggccaagcgcttccaccttcccggaattcggcagggatacgggctcacggagacaacatccgcgatccttatcacgcccgagggtgacgataagccgggagccgtcggaaaagtggtccccttctttgaagccaaggtcgtagacctcgacacgggaaaaaccctcggagtgaaccagaggggcgagctctgcgtgagagggccgatgatcatgtcaggttacgtgaataaccctgaagcgacgaatgcgctgatcgacaaggatgggtggttgcattcgggagacattgcctattgggatgaggatgagcacttctttatcgtagatcgacttaagagcttgatcaaatacaaaggctatcaggtagcgcctgccgagctcgagtcaatcctgctccagcaccccaacattttcgacgccggagtggccgggttgcccgatgacgacgcgggtgagctgccagcggccgtggtagtcctcgaacatgggaaaacaatgaccgaaaaggagatcgtggactacgtagcatcacaagtgacgactgcgaagaaactgaggggaggggtagtctttgtggacgaggtcccgaaaggcttgactgggaagcttgacgctcgcaaaatccgggaaatcctgattaaggcaaagaaaggcgggaaaatcgctgtctgataagctgccttctgcggggcttgccttctggccatgcccttcttctctcccttgcacctgtacctcttggtctttgaataaagcctgagtaggaaggcggccgctcgagcatgcatctaga

SEQ ID NO: 56162 - RNA, 1796 nt, Artificial Sequence
  Description of Artificial Sequence: Synthetic transcript sequence
gggaaauaagagagaaaagaagaguaagaagaaauauaagagccaccauggaagaugcgaagaacaucaagaagggaccugccccguuuuacccuuuggaggacgguacagcaggagaacagcuccacaaggcgaugaaacgcuacgcccugguccccggaacgauugcguuuaccgaugcacauauugagguagacaucacauacgcagaauacuucgaaaugucggugaggcuggcggaagcgaugaagagauauggucuuaacacuaaucaccgcaucgugguguguucggagaacucauugcaguuuuucaugccgguccuuggagcacuuuucaucggggucgcagucgcgccagcgaacgacaucuacaaugagcgggaacucuugaauagcaugggaaucucccagccgacggucguguuugucuccaaaaaggggcugcagaaaauccucaacgugcagaagaagcuccccauuauucaaaagaucaucauuauggauagcaagacagauuaccaaggguuccagucgauguauaccuuugugacaucgcauuugccgccaggguuuaacgaguaugacuucguccccgagucauuugacagagauaaaaccaucgcgcugauuaugaauuccucggguagcaccgguuugccaaaggggguggcguugccccaccgcacugcuugugugcgguucucgcacgcuagggauccuaucuuugguaaucagaucauucccgacacagcaauccuguccgugguaccuuuucaucacgguuuuggcauguucacgacucucggcuauuugauuugcgguuucagggucguacuuauguaucgguucgaggaagaacuguuuuugagauccuugcaagauuacaagauccagucggcccuccuugugccaacgcuuuucucauucuuugcgaaaucgacacuuauugauaaguaugaccuuuccaaucugcaugagauugccucagggggagcgccgcuuagcaaggaagucggggaggcaguggccaagcgcuuccaccuucccggaauucggcagggauacgggcucacggagacaacauccgcgauccuuaucacgcccgagggugacgauaagccgggagccgucggaaaagugguccccuucuuugaagccaaggucguagaccucgacacgggaaaaacccucggagugaaccagaggggcgagcucugcgugagagggccgaugaucaugucagguuacgugaauaacccugaagcgacgaaugcgcugaucgacaaggaugggugguugcauucgggagacauugccuauugggaugaggaugagcacuucuuuaucguagaucgacuuaagagcuugaucaaauacaaaggcuaucagguagcgccugccgagcucgagucaauccugcuccagcaccccaacauuuucgacgccggaguggccggguugcccgaugacgacgcgggugagcugccagcggccgugguaguccucgaacaugggaaaacaaugaccgaaaaggagaucguggacuacguagcaucacaagugacgacugcgaagaaacugaggggagggguagucuuuguggacgaggucccgaaaggcuugacugggaagcuugacgcucgcaaaauccgggaaauccugauuaaggcaaagaaaggcgggaaaaucgcugucugauaagcugccuucugcggggcuugccuucuggccaugcccuucuucucucccuugcaccuguaccucuuggucuuugaauaaagccugaguaggaag

SEQ ID NO: 56163 - DNA, 905 bp, Artificial Sequence
  Description of Artificial Sequence: Synthetic transcript sequence
taatacgactcactatagggaaataagagagaaaagaagagtaagaagaaatataagagccaccatggtgtccaagggtgaggaattgtttaccggggtggtgcctattctcgtcgaacttgacggggatgtgaatggacacaagttttcggtatccggagaaggagagggtgacgccacatacggaaagcttacactcaaattcatctgtacgacggggaaactgcccgtaccctggcctacgctcgtaaccacgctgacttatggagtgcagtgctttagcagataccccgaccatatgaagcagcacgacttcttcaagtcggcgatgcccgaggggtacgtgcaagagaggaccattttcttcaaagacgatggcaattacaaaacacgcgcagaagtcaagtttgagggcgatactctggtcaatcggatcgaattgaagggaatcgatttcaaagaagatggaaacatccttggccataagctcgagtacaactataactcgcataatgtctatatcatggctgacaagcagaaaaacggtatcaaagtcaactttaagatccgacacaatattgaggacggttcggtgcagcttgcggaccactatcaacagaatacgccgattggggatggtccggtccttttgccggataaccattatctctcaacccagtcagccctgagcaaagatccaaacgagaagagggaccacatggtcttgctcgaattcgtgacagcggcagggatcactctgggaatggacgagttgtacaagtgataagctgccttctgcggggcttgccttctggccatgcccttcttctctcccttgcacctgtacctcttggtctttgaataaagcctgagtaggaaggcggccgctcgagcatgcatctaga

SEQ ID NO: 56164 - RNA, 863 nt, Artificial Sequence
  Description of Artificial Sequence: Synthetic transcript sequence
gggaaauaagagagaaaagaagaguaagaagaaauauaagagccaccaugguguccaagggugaggaauuguuuaccgggguggugccuauucucgucgaacuugacggggaugugaauggacacaaguuuucgguauccggagaaggagagggugacgccacauacggaaagcuuacacucaaauucaucuguacgacggggaaacugcccguacccuggccuacgcucguaaccacgcugacuuauggagugcagugcuuuagcagauaccccgaccauaugaagcagcacgacuucuucaagucggcgaugcccgagggguacgugcaagagaggaccauuuucuucaaagacgauggcaauuacaaaacacgcgcagaagucaaguuugagggcgauacucuggucaaucggaucgaauugaagggaaucgauuucaaagaagauggaaacauccuuggccauaagcucgaguacaacuauaacucgcauaaugucuauaucauggcugacaagcagaaaaacgguaucaaagucaacuuuaagauccgacacaauauugaggacgguucggugcagcuugcggaccacuaucaacagaauacgccgauuggggaugguccgguccuuuugccggauaaccauuaucucucaacccagucagcccugagcaaagauccaaacgagaagagggaccacauggucuugcucgaauucgugacagcggcagggaucacucugggaauggacgaguuguacaagugauaagcugccuucugcggggcuugccuucuggccaugcccuucuucucucccuugcaccuguaccucuuggucuuugaauaaagccugaguaggaag

SEQ ID NO: 56165 - RNA, 716 nt, Artificial Sequence
  Description of Artificial Sequence: Synthetic transcript sequence
gggaaauaagagagaaaagaagaguaagaagaaauauaagagccaccaugaacuuucucuugucaugggugcacuggagccuugcgcugcugcuguaucuucaucacgcuaaguggagccaggccgcacccauggcggaggguggcggacagaaucaccacgaaguagucaaauucauggacguguaccagaggucguauugccauccgauugaaacucuuguggauaucuuucaagaauaccccgaugaaaucgaguacauuuucaaaccgucgugugucccucucaugaggugcgggggaugcugcaaugaugaaggguuggaguguguccccacggaggagucgaauaucacaaugcaaaucaugcgcaucaaaccacaucagggucagcauauuggagagauguccuuucuccagcacaacaaaugugaguguagaccgaagaaggaccgagcccgacaggaaaacccaugcggaccgugcuccgagcggcgcaaacacuuguucguacaagacccccagacaugcaagugcucauguaagaauaccgauucgcgguguaaggcgagacagcuggaauugaacgagcgcacguguaggugcgacaagccuagacggugagcugccuucugcggggcuugccuucuggccaugcccuucuucucucccuugcaccuguaccucuuggucuuugaauaaagccugaguaggaag

SEQ ID NO: 56166 - RNA, 1316 nt, Artificial Sequence
  Description of Artificial Sequence: Synthetic transcript sequence
gggaaauaagagagaaaagaagaguaagaagaaauauaagagccaccaugcccccaucgggauugagauuguugccccuucugcuuccgcugcuuugguugcucguccugaccccuggcaggcccgcagcgggguugucgacguguaagacgauugacauggagcucgugaaacgcaagagaauugaagcaaucaggggucaaauucugagcaaacucagacucgcauccccaccgucccagggugaggucccaccgggaccucugcccgaggcgguccuggccuuguacaacucgacacgcgaccgagucgcaggggagucagcggaacccgagcccgaacccgaggccgacuacuacgccaaagaggucacucgggucuugaugguggaaacucacaacgaaaucuacgacaaguuuaagcagucgacccauucgaucuacauguucuucaauaccagcgagcuuagagaagcgguccccgagccgguacuuuuguccagagcggagcugcgguugcucaggcucaagcugaaaguggaacagcacguagagcuuuaucagaaguacagcaacaauucauggcgguaucucucgaaccggcuguuggcgccgucggauucacccgaauggcucagcuuugaugucacggggguggugcgccagugguuguccaggggcggagagaucgaaggauuucggcucucagcccacuguucgugugauagcagggacaacacgcuccaaguagauaucaacggauucacuacuggucgcagaggggaucuugcgacaauccacgguaugaaucgcccuuuucuccugcugauggccacaccccuugaacgggcgcaacaucuucagucaucccgccauaggagagcacuggacacgaacuacuguuuuucgucgacagagaagaauugcugcgugcggcagcuuuacaucgacuuccgaaaagaucucggguggaaauggauucaugaaccgaagggguaucacgccaacuucugccuggguccguguccuuauaucuggucguuggauacacaguauucaaagguguuggcucuuuacaaucagcacaacccgggagccucggcugcgccuuguugcguaccccaggcauuggagccauugccgauuguguauuaugugggaagaaagccgaaaguggagcaguugucgaauaugaucguacggagcugcaaaugcuccugauaagcugccuucugcggggcuugccuucuggccaugcccuucuucucucccuugcaccuguaccucuuggucuuugaauaaagccugaguaggaag

SEQ ID NO: 56167 - RNA, 806 nt, Artificial Sequence
  Description of Artificial Sequence: Synthetic transcript sequence
gggaaauaagagagaaaagaagaguaagaagaaauauaagagccaccauggguguaaggcacccgcccugcucccacagacuccuggcggugugugccuugguaucgcuugcgaccgccgcacugcuugucaauccggggguagucgugcgcaucagccagaagggacuggauuacgccucgcagcaggguaccgcggcacuucagaaagagcuuaagcggaucaagauuccagacuauucagauagcuuuaagaucaagcauuugggaaaaggucacuauucguuuuacucgauggacauuagagaauuccagcucccuucgucccaaauuuccauggucccgaauguggggcugaaauucagcauuucgaacgcgaacaucaagaucucagggaaauggaaggcacagaagcgauuucucaaaaugucaggaaacuuugaucucuccaucgaggggaugucaaucucggcggacuugaaacucggcuccaauccuacaucgggaaagcccacuauuacggccucgucguguucgagccauaucaacucggugcacguccauaucucaaaguccaaaguaggauggcuuauccagcucuuccacaaaaagauugagucggcuuugcgcaacaagaugaauagccaagugugcgagaaagucacaaauuccgugucaucagaauugcagcccuacuuccaaacgcuguaaugagcugccuucugcggggcuugccuucuggccaugcccuucuucucucccuugcaccuguaccucuuggucuuugaauaaagccugaguaggaag

SEQ ID NO: 56168 - RNA, 1573 nt, Artificial Sequence
  Description of Artificial Sequence: Synthetic transcript sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaggaagcggagcuacuaacuucagccugcugaagcaggcuggagacguggaggagaacccuggaccuaugguguccaagggugaggaauuguuuaccgggguggugccuauucucgucgaacuugacggggaugugaauggacacaaguuuucgguauccggagaaggagagggugacgccacauacggaaagcuuacacucaaauucaucuguacgacggggaaacugcccguacccuggccuacgcucguaaccacgcugacuuauggagugcagugcuuuagcagauaccccgaccauaugaagcagcacgacuucuucaagucggcgaugcccgagggguacgugcaagagaggaccauuuucuucaaagacgauggcaauuacaaaacacgcgcagaagucaaguuugagggcgauacucuggucaaucggaucgaauugaagggaaucgauuucaaagaagauggaaacauccuuggccauaagcucgaguacaacuauaacucgcauaaugucuauaucauggcugacaagcagaaaaacgguaucaaagucaacuuuaagauccgacacaauauugaggacgguucggugcagcuugcggaccacuaucaacagaauacgccgauuggggaugguccgguccuuuugccggauaaccauuaucucucaacccagucagcccugagcaaagauccaaacgagaagagggaccacauggucuugcucgaauucgugacagcggcagggaucacucugggaauggacgaguuguacaagugauaauggucuuugaauaaagccugaguaggaag

SEQ ID NO: 56169 - RNA, 1568 nt, Artificial Sequence
  Description of Artificial Sequence: Synthetic transcript sequence
gggaaauaagagagaaaagaagaguaagaagaaauauaagagccaccauggccgugauggcgccgcggacccugguccuccugcugucgggcgcccucgcccugacgcagaccugggccgaggugcagcuggucgagagcggcgggggccucgugcagccgggcgggucgcugcggcugagcugcgccgcgagcggguucaacaucaaggacaccuacauccacugggugcgccaggcccccggcaagggccucgagugggucgcccggaucuaccccacgaacggguacacccgcuacgccgacagcgugaagggccgguucaccaucagcgcggacaccucgaagaacacggccuaccugcagaugaacagccugcgcgccgaggacaccgccguguacuacugcagccgguggggcggcgacggguucuacgccauggacuacugggggcagggcacccucgucaccgugagcagcgcgucgacgaaggggcccagcguguucccgcuggcccccagcagcaagagcaccagcggcgggaccgccgcccugggcugccucgucaaggacuacuuccccgagcccgugaccgugucguggaacagcggcgcgcugacgagcgggguccacaccuucccggccgugcugcagagcagcggccucuacucgcugagcagcguggucaccgugcccagcagcagccuggggacccagacguacaucugcaacgugaaccacaagcccucgaacaccaaggucgacaagaagguggagcccaagagcugcgacaagacccacaccugcccgcccugccccgcccccgagcuccugggcgggcccagcguguuccuguucccgcccaagcccaaggacacgcucaugaucagccgcacccccgaggucaccugcgugguggucgacgugagccacgaggaccccgaggugaaguucaacugguacgucgacggcguggaggugcacaacgccaagaccaagccgcgggaggagcaguacaacucgacguaccgcgucgugagcgugcugaccguccugcaccaggacuggcucaacggcaaggaguacaagugcaaggugagcaacaaggcccugcccgcgcccaucgagaagaccaucagcaaggccaaggggcagccccgggagccgcagguguacacccugccccccagccgcgacgagcucacgaagaaccaggucagccugaccugccuggugaagggcuucuaccccucggacaucgccguggagugggagagcaacgggcagccggagaacaacuacaagaccaccccgcccguccucgacagcgacggcagcuucuuccuguacagcaagcugacgguggacaagucgcgguggcagcagggcaacguguucagcugcagcgucaugcacgaggcccuccacaaccacuacacccagaagagccugagccugagccccgggugauaauaggcugccuucugcggggcuugccuucuggccaugcccuucuucucucccuugcaccuguaccucuuggucuuugaauaaagccugaguaggaag

SEQ ID NO: 56170 - RNA, 863 nt, Artificial Sequence
  Description of Artificial Sequence: Synthetic transcript sequence
gggaaauaagagagaaaagaagaguaagaagaaauauaagagccaccauggccgugauggcgccgcggacccugguccuccugcugucgggcgcccucgcccugacgcagaccugggccgacauccagaugacccagagcccgucgagccugagcgccagcgugggcgaccgggucacgaucaccugccgcgcgagccaggacgugaacaccgccguggccugguaccagcagaagcccgggaaggcccccaagcuccugaucuacucggcgagcuuccuguacagcggcguccccagccgguucagcgggucgcgcagcggcaccgacuucacgcucaccaucagcagccugcagccggaggacuucgccaccuacuacugccagcagcacuacaccacgccccccaccuucgggcagggcaccaagguggagaucaagcggaccguggccgcccccagcgucuucaucuucccgcccagcgacgagcagcugaagucgggcacggccagcguggugugccuccugaacaacuucuacccccgcgaggcgaagguccaguggaagguggacaacgcccugcagagcgggaacagccaggagagcgugaccgagcaggacucgaaggacagcaccuacagccucagcagcacccugacgcugagcaaggccgacuacgagaagcacaaggucuacgccugcgaggugacccaccaggggcucucgagccccgugaccaagagcuucaaccggggcgagugcugauaauaggcugccuucugcggggcuugccuucuggccaugcccuucuucucucccuugcaccuguaccucuuggucuuugaauaaagccugaguaggaag
